United States Patent 12,097,253 (RSV RNA MOLECULES AND COMPOSITIONS FOR VACCINATION) - sequence listing, part 9

SEQ ID NO: 12430 - RNA, 2115 nt, synthetic construct
  misc_feature 1..2115: note = mRNA product Design h-5 comprising derived and/or modified sequence from HRSV(Memphis-37)__AIY60640.1__F-del (opt6)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12431 - RNA, 2115 nt, synthetic construct
  misc_feature 1..2115: note = mRNA product Design h-5 comprising derived and/or modified sequence from HRSV(Memphis-37)__AIY60640.1__F-del (opt11)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12432 - RNA, 2048 nt, synthetic construct
  misc_feature 1..2048: note = mRNA product Design i-1 comprising derived and/or modified sequence from HRSV(Memphis-37)__AIY60640.1__F-del (wt)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12433 - RNA, 2048 nt, synthetic construct
  misc_feature 1..2048: note = mRNA product Design i-1 comprising derived and/or modified sequence from HRSV(Memphis-37)__AIY60640.1__F-del (opt1)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12434 - RNA, 2048 nt, synthetic construct
  misc_feature 1..2048: note = mRNA product Design i-1 comprising derived and/or modified sequence from HRSV(Memphis-37)__AIY60640.1__F-del (opt2)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12435 - RNA, 2048 nt, synthetic construct
  misc_feature 1..2048: note = mRNA product Design i-1 comprising derived and/or modified sequence from HRSV(Memphis-37)__AIY60640.1__F-del (opt3)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12436 - RNA, 2048 nt, synthetic construct
  misc_feature 1..2048: note = mRNA product Design i-1 comprising derived and/or modified sequence from HRSV(Memphis-37)__AIY60640.1__F-del (opt4)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12437 - RNA, 2048 nt, synthetic construct
  misc_feature 1..2048: note = mRNA product Design i-1 comprising derived and/or modified sequence from HRSV(Memphis-37)__AIY60640.1__F-del (opt5)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12438 - RNA, 2048 nt, synthetic construct
  misc_feature 1..2048: note = mRNA product Design i-1 comprising derived and/or modified sequence from HRSV(Memphis-37)__AIY60640.1__F-del (opt6)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12439 - RNA, 2048 nt, synthetic construct
  misc_feature 1..2048: note = mRNA product Design i-1 comprising derived and/or modified sequence from HRSV(Memphis-37)__AIY60640.1__F-del (opt11)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12440 - RNA, 2048 nt, synthetic construct
  misc_feature 1..2048: note = mRNA product Design i-2 comprising derived and/or modified sequence from HRSV(Memphis-37)__AIY60640.1__F-del (wt)
  source 1..2048: mol_type = other RNA
gggagaggcgctgcctacggaggtggcagccatctccttctcggcatcaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12441 - RNA, 2048 nt, synthetic construct
  misc_feature 1..2048: note = mRNA product Design i-2 comprising derived and/or modified sequence from HRSV(Memphis-37)__AIY60640.1__F-del (opt1)
  source 1..2048: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12442 - RNA, 2048 nt, synthetic construct
  misc_feature 1..2048: note = mRNA product Design i-2 comprising derived and/or modified sequence from HRSV(Memphis-37)__AIY60640.1__F-del (opt2)
  source 1..2048: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12443 - RNA, 2048 nt, synthetic construct
  misc_feature 1..2048: note = mRNA product Design i-2 comprising derived and/or modified sequence from HRSV(Memphis-37)__AIY60640.1__F-del (opt3)
  source 1..2048: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12444 - RNA, 2048 nt, synthetic construct
  misc_feature 1..2048: note = mRNA product Design i-2 comprising derived and/or modified sequence from HRSV(Memphis-37)__AIY60640.1__F-del (opt4)
  source 1..2048: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12445 - RNA, 2048 nt, synthetic construct
  misc_feature 1..2048: note = mRNA product Design i-2 comprising derived and/or modified sequence from HRSV(Memphis-37)__AIY60640.1__F-del (opt5)
  source 1..2048: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12446 - RNA, 2048 nt, synthetic construct
  misc_feature 1..2048: note = mRNA product Design i-2 comprising derived and/or modified sequence from HRSV(Memphis-37)__AIY60640.1__F-del (opt6)
  source 1..2048: mol_type = other RNA
gggagaggcgctgcctacggaggtggcagccatctccttctcggcatcaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12447 - RNA, 2048 nt, synthetic construct
  misc_feature 1..2048: note = mRNA product Design i-2 comprising derived and/or modified sequence from HRSV(Memphis-37)__AIY60640.1__F-del (opt11)
  source 1..2048: mol_type = other RNA
gggagaggcgctgcctacggaggtggcagccatctccttctcggcatcaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12448 - RNA, 2044 nt, synthetic construct
  misc_feature 1..2044: note = mRNA product Design i-2 comprising derived and/or modified sequence from HRSV(Memphis-37)__AIY60640.1__F-del (wt)
  source 1..2044: mol_type = other RNA
ggggcgctgcctacggaggtggcagccatctccttctcggcatcaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12449 - RNA, 2044 nt, synthetic construct
  misc_feature 1..2044: note = mRNA product Design i-2 comprising derived and/or modified sequence from HRSV(Memphis-37)__AIY60640.1__F-del (opt1)
  source 1..2044: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12450 - RNA, 2044 nt, synthetic construct
  misc_feature 1..2044: note = mRNA product Design i-2 comprising derived and/or modified sequence from HRSV(Memphis-37)__AIY60640.1__F-del (opt2)
  source 1..2044: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12451 - RNA, 2044 nt, synthetic construct
  misc_feature 1..2044: note = mRNA product Design i-2 comprising derived and/or modified sequence from HRSV(Memphis-37)__AIY60640.1__F-del (opt3)
  source 1..2044: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12452 - RNA, 2044 nt, synthetic construct
  misc_feature 1..2044: note = mRNA product Design i-2 comprising derived and/or modified sequence from HRSV(Memphis-37)__AIY60640.1__F-del (opt4)
  source 1..2044: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12453 - RNA, 2044 nt, synthetic construct
  misc_feature 1..2044: note = mRNA product Design i-2 comprising derived and/or modified sequence from HRSV(Memphis-37)__AIY60640.1__F-del (opt5)
  source 1..2044: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12454 - RNA, 2044 nt, synthetic construct
  misc_feature 1..2044: note = mRNA product Design i-2 comprising derived and/or modified sequence from HRSV(Memphis-37)__AIY60640.1__F-del (opt6)
  source 1..2044: mol_type = other RNA
ggggcgctgcctacggaggtggcagccatctccttctcggcatcaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12455 - RNA, 2044 nt, synthetic construct
  misc_feature 1..2044: note = mRNA product Design i-2 comprising derived and/or modified sequence from HRSV(Memphis-37)__AIY60640.1__F-del (opt11)
  source 1..2044: mol_type = other RNA
ggggcgctgcctacggaggtggcagccatctccttctcggcatcaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12456 - RNA, 1879 nt, synthetic construct
  misc_feature 1..1879: note = mRNA product Design i-3 comprising derived and/or modified sequence from HRSV(Memphis-37)__AIY60640.1__F-del (wt)
  source 1..1879: mol_type = other RNA
gggagaaagcttaccatggagttgccaatcctcaaaacaaatgcaattaccacaatccttgctgcagtcacactctgtttcgcttccagtcaaaacatcactgaagaattttatcaatcaacatgcagtgcagttagcaaaggctatcttagtgctttaagaactggttggtatactagtgttataactatagaattaagtaatatcaaggaaaataagtgtaatggaacagatgctaaggtaaaattgataaaacaagaattagataaatataaaaatgctgtaacagaattgcagttgctcatgcaaagcacaccagcagccaacaatcgagccagaagagaactaccaaggtttatgaattatacactcaacaataccaaaaataacaatgtaacattaagcaagaaaaggaaaagaagatttcttggctttttgttaggtgttggatctgcaatcgccagtggcattgctgtatctaaagtcctgcacctagaaggggaagtgaacaaaatcaaaaatgctctactatccacaaacaaggctgtagtcagcttatcaaatggagttagtgtcttaaccagcaaagtgttagacctcaaaaactatatagataaacagttgttacccattgtgaacaagcaaagctgcagcatatcaaacattgaaactgtgatagaattccaacaaaagaacaacagactactagagattaccagggaatttagtgttaatgcaggtgtaactacacctgtaagcacttatatgttaacaaatagtgaattattatcattaatcaatgatatgcctataacaaatgatcagaaaaagttaatgtccaacaatgttcaaatagttagacagcaaagttactctatcatgtccataataaaggaggaagtcttagcatatgtagttcaattaccactatatggtgtaatagatacaccttgttggaaactacacacatcccctctatgcacaaccaacacaaaggaagggtccaacatctgtttaacaagaaccgacagaggatggtactgtgacaatgcaggatcagtgtctttcttcccacaagctgaaacatgcaaagttcaatcgaatcgagtattttgtgacacaatgaacagtctaacattaccaagtgaagtaaatctctgcaacattgacatattcaaccctaaatatgattgcaaaattatgacttcaaaaacagatgtgagcagctccgttatcacatctctaggagccattgtgtcatgctatggcaaaactaaatgtacagcatccaataaaaatcgtggaatcataaagacattttctaacgggtgtgattatgtatcaaataagggggtggacactgtatctgtaggtaatacattatattatgtaaataagcaagaaggaaaaagcctctatgtaaaaggtgaaccaataataaatttctatgacccattagtgttcccttctgatgaatttgatgcatcaatatctcaagtcaatgagaagattaaccagagcctagcatttattcgtaaatccgatgaattattacataatgtaaatgttggtaaatccaccacaaatatcatgataactactataattatagtgattatagtaatattgttattattaattgcagttgggctgttcctatactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12457 - RNA, 1879 nt, synthetic construct
  misc_feature 1..1879: note = mRNA product Design i-3 comprising derived and/or modified sequence from HRSV(Memphis-37)__AIY60640.1__F-del (opt1)
  source 1..1879: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtcagcaaggtgctgcacctcgagggcgaggtgaacaagatcaagaacgccctgctgtccaccaacaaggccgtcgtgagcctctccaacggggtgagcgtcctgacctccaaggtgctggacctcaagaactacatcgacaagcagctgctgcccatcgtgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtccatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12458 - RNA, 1879 nt, synthetic construct
  misc_feature 1..1879: note = mRNA product Design i-3 comprising derived and/or modified sequence from HRSV(Memphis-37)__AIY60640.1__F-del (opt2)
  source 1..1879: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctccaaggtcctccacctcgagggcgaggtcaacaagatcaagaacgccctcctctccaccaacaaggccgtcgtctccctctccaacggcgtctccgtcctcacctccaaggtcctcgacctcaagaactacatcgacaagcagctcctccccatcgtcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtccatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12459 - RNA, 1879 nt, synthetic construct
  misc_feature 1..1879: note = mRNA product Design i-3 comprising derived and/or modified sequence from HRSV(Memphis-37)__AIY60640.1__F-del (opt3)
  source 1..1879: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtccaaggttctgcaccttgaaggcgaggtgaacaagattaaaaatgcgttgctgtctaccaacaaggcagtcgtgagcctatccaacggtgtatcagttctcacaagtaaagtgctggaccttaagaattatatcgataaacaactgttgccgattgtcaacaagcagagctgttctatctccaatatagaaactgtgattgagtttcagcagaaaaacaatcggctcctggagatcacccgcgagttctcagtgaacgccggggtcacaacccccgttagcacgtacatgttaactaatagtgaactgctctctcttattaacgacatgcctatcacaaatgatcaaaagaagctgatgtccaacaatgtgcagatcgtaagacagcagagctattcgattatgtctataatcaaagaagaggtgttggcttacgtcgtgcaactaccactgtacggagttattgacaccccctgctggaagctccatacttcccctctgtgtacaaccaacacgaaagaaggctcaaatatctgccttaccaggacagatcggggctggtattgtgacaacgccgggagtgtgagctttttcccacaggcagagacttgcaaggtccagtccaatcgcgtgttttgtgataccatgaactctctgacattgcccagcgaggtaaacctctgcaatatagacattttcaaccctaaatacgattgtaagatcatgacttcaaagaccgacgttagttccagcgtgatcacatctctgggagctattgtctcatgctatggtaaaaccaagtgcactgccagtaataaaaaccgaggcatcattaagacgtttagcaatgggtgtgattacgtgtccaacaaaggagtcgacacagtgtctgttggcaataccttatattacgtgaacaagcaagaaggtaagtcgctgtatgtaaaaggggagccaataatcaatttctacgacccgctagtctttcccagcgatgagttcgacgcgtccatttcacaggtgaacgaaaagatcaatcagagtctcgccttcatcagaaaatctgatgaactgcttcacaacgttaatgtgggaaagagcactaccaacattatgataacaaccatcattatcgtcattatcgtgatattgctgctcctgatcgcagtaggcctttttctgtactgcaaagctaggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12460 - RNA, 1879 nt, synthetic construct
  misc_feature 1..1879: note = mRNA product Design i-3 comprising derived and/or modified sequence from HRSV(Memphis-37)__AIY60640.1__F-del (opt4)
  source 1..1879: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgagcaaggtgctgcacctggagggcgaggtgaacaagatcaagaacgccctgctgagcaccaacaaggccgtggtgagcctgagcaacggcgtgagcgtgctgaccagcaaggtgctggacctgaagaactacatcgacaagcagctgctgcccatcgtgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgagcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12461 - RNA, 1879 nt, synthetic construct
  misc_feature 1..1879: note = mRNA product Design i-3 comprising derived and/or modified sequence from HRSV(Memphis-37)__AIY60640.1__F-del (opt5)
  source 1..1879: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttctaaggtgcttcacctggaaggggaggtcaacaagattaaaaatgccctcctgtccaccaacaaggctgtggttagcctgtctaacggagtgtccgtcctcacgagcaaagtgctggaccttaagaattatatcgataaacaactgctccccattgtgaacaagcagtcttgttccatcagcaatattgaaacagtcatcgagtttcagcagaaaaacaatcgcctgcttgagatcaccagagaattttccgttaacgccggcgtgacaacccctgtgtctacctacatgctgacaaatagcgagctcctgtccctgattaacgacatgcccatcacgaatgatcaaaagaagctcatgagcaacaatgtccagattgtgcggcagcagtcttattccatcatgagcattatcaaagaagaggttctggcgtacgtggtccaacttcctctgtacggcgtgatcgacaccccctgctggaagctccatacatctcctctgtgtaccacaaacaccaaagaagggagcaatatttgccttacgcgcacagatagaggatggtattgtgacaacgccggctccgtttctttcttcccgcaggctgagacctgcaaggtgcagagcaatcgggtcttttgtgataccatgaactccctgacactccccagcgaggtgaacctgtgcaatatcgacattttcaaccctaaatacgattgtaagatcatgacctctaagacagacgtctccagctctgtgattacgtccctgggggccatcgttagctgctatggaaaaaccaagtgcacagcttccaataaaaaccgcggcatcattaagaccttttctaatgggtgtgattacgtgagcaacaaaggagtcgacacagtgtccgttggcaataccctctattacgtgaacaagcaagaaggcaagtctctgtatgtcaaaggggagcccatcattaatttctacgaccctcttgtgtttcccagcgatgagttcgacgcctccatcagccaggtgaacgaaaagattaatcagtctctggccttcatcagaaaatccgatgaactcctgcacaacgttaatgtcggaaagagcacgaccaacattatgatcacaaccatcattatcgtgattatcgtgattctgcttctcctgatcgctgtcggcctgtttctctactgcaaagcgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12462 - RNA, 1879 nt, synthetic construct
  misc_feature 1..1879: note = mRNA product Design i-3 comprising derived and/or modified sequence from HRSV(Memphis-37)__AIY60640.1__F-del (opt6)
  source 1..1879: mol_type = other RNA
gggagaaagcttaccatggaactcccaatattaaaaactaacgcaatcacaaccatattagcagccgtcactctatgctttgcctcctcacaaaatataacagaagaattttaccaatccacatgctcagccgttagcaaaggatatctatcagccctaagaacaggctggtatacttcagtaataacaatagaactatcaaatataaaagaaaacaaatgcaacggaaccgacgctaaagtaaagctcataaaacaagaattagacaaatacaaaaatgcagtaacagaactacaactcctaatgcaatcaaccccagccgccaataacagagctagacgagaactaccccgattcatgaattacacactaaacaacacaaaaaacaacaatgtaacactctcaaaaaaaagaaaacgaagattcttaggttttctcctgggagtaggatcagcaatcgcttccggaatcgcagtcagtaaagtccttcaccttgaaggcgaagtaaacaaaataaaaaatgcactactatctacaaataaagcagtagtatccctatccaatggcgtctcagtattaacctcaaaagtactcgaccttaaaaattatatagacaaacaattactacccatagtcaataaacaatcctgttccatatcaaacatagaaacagtaatcgaatttcaacaaaaaaacaacagattactagaaataacacgcgaattttcagtcaacgccggagtaaccacacccgtctcaacatacatgctaaccaactccgaactactatcacttatcaacgacatgccaataacaaatgaccaaaaaaaactcatgtcaaacaacgtacaaatagtccgccaacaatcatactctataatgtctattatcaaagaagaagttctcgcatacgtagtacaactaccactatatggtgtcatagacacaccatgttggaaactccatacatcacccttatgtacaaccaatacaaaagaaggctcaaacatctgcctaactcgaacagaccgaggatggtactgcgacaatgcaggatctgtctcattcttccctcaagcagaaacatgtaaagttcaatctaatagagttttctgcgatacaatgaactcactaactctaccatcagaagtaaatctctgtaatattgacatattcaacccaaaatacgattgcaagatcatgacatcaaaaactgacgtatcatcctcagtcatcacctcattaggagcaatcgtaagctgttacgggaaaacaaaatgcaccgcttctaacaaaaatagaggaataattaaaaccttctcaaacggatgcgattacgtctccaataaaggagtagatacagtaagcgtaggaaatactctatactacgtcaataaacaagaaggaaaatcactttatgtcaaaggagaacccataataaatttctacgacccattagtcttcccatcagatgaatttgacgcatccatatcccaagtcaacgaaaaaatcaatcaatcactagcattcatacgaaaatcagacgaactactacacaacgttaacgtaggaaaatcaacaaccaacatcatgataaccactataataatcgtcataatagtcatcctattattactaatagccgtaggccttttcctatactgtaaagctagataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12463 - RNA, 1879 nt, synthetic construct
  misc_feature 1..1879: note = mRNA product Design i-3 comprising derived and/or modified sequence from HRSV(Memphis-37)__AIY60640.1__F-del (opt11)
  source 1..1879: mol_type = other RNA
gggagaaagcttaccatggaactcccgatcctcaaaaccaacgccatcaccactatcctcgccgccgtaaccctctgcttcgcctcatcccaaaacatcaccgaagaattttaccaatccacatgctccgccgtctccaaaggttacctctcagccctccgcaccggctggtacacctccgttatcaccatcgaactttccaacataaaagagaacaagtgcaacggcaccgacgcaaaagtaaaactaatcaaacaagaactagacaaatacaaaaacgccgtcaccgaactccagctcctcatgcaatcgacgcccgccgccaacaaccgagcaaggcgcgaacttccacgcttcatgaactacaccctcaacaacactaaaaacaacaacgtgaccctatccaaaaagcgtaaacgccgattcctaggtttccttctcggtgtcggctccgccattgcctccggcatcgctgtttccaaagtcctccacctcgaaggcgaagtaaacaagataaaaaacgccctcctctctacaaacaaggccgtggtatcgctctctaacggcgtctctgtactcacctccaaagtcctcgacctcaaaaactacatcgacaagcaactcctccctatcgtcaataaacaatcctgctccatttccaacatcgaaacagtgatcgaatttcaacaaaaaaacaaccgattactagaaatcacccgcgaattttcagtcaacgccggcgtcacaacgccagtctcaacctacatgctcaccaactcagaactcttatcactcatcaacgacatgcccatcactaacgaccagaaaaaactgatgtccaacaacgtgcaaatagtccgccaacagtcctactccatcatgtccataatcaaggaggaggtgctcgcctacgtagtccaactccccctctacggagtcattgacaccccttgctggaaactacacacctcccctctctgcaccaccaacaccaaagaaggcagcaacatctgcctaaccaggacggaccgaggatggtactgcgacaatgcaggctccgtcagcttcttcccacaagccgaaacatgcaaagttcaatcaaaccgtgtattctgcgacaccatgaactcactcaccctcccctcagaagtaaacctatgcaacatagatatcttcaaccccaaatacgactgcaaaattatgacctccaaaaccgatgtctccagctccgttatcacgtcactcggcgccatcgtctcctgctacggcaagaccaaatgcaccgcctccaacaaaaaccgcggaataatcaaaacattctctaacggctgcgactacgtctccaataaaggcgtcgacaccgtctccgtgggcaacacgctgtactacgtcaacaaacaagaaggcaaatctctttacgtcaaaggtgaaccaatcatcaacttctacgaccccctcgtattcccctccgacgaatttgacgcgagcatctcccaagtcaacgaaaagatcaaccaatccctcgccttcatccgaaaaagcgacgaactcctccacaacgtcaacgtcggcaaaagtaccacaaacattatgatcaccaccatcatcatagtcatcatcgtcatcctgctcctactaatagccgtcggcctcttcttgtactgcaaggcacgatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12464 - protein, 574 aa, synthetic construct
  REGION 1..574: note = derived and/or modified protein sequence (artificial) from HRSV(Memphis-37)__AIY60640.1__F0_DSCav1
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVCKVLHLEGEVNKIKNALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 12465 - RNA, 1725 nt, synthetic construct
  misc_feature 1..1725: note = derived and/or modified CDS sequence (opt1) from HRSV(Memphis-37)__AIY60640.1__F0_DSCav1
  source 1..1725: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactga

SEQ ID NO: 12466 - RNA, 1725 nt, synthetic construct
  misc_feature 1..1725: note = derived and/or modified CDS sequence (opt1) from HRSV(Memphis-37)__AIY60640.1__F0_DSCav1
  source 1..1725: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactga

SEQ ID NO: 12467 - RNA, 1725 nt, synthetic construct
  misc_feature 1..1725: note = derived and/or modified CDS sequence (opt2) from HRSV(Memphis-37)__AIY60640.1__F0_DSCav1
  source 1..1725: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactga

SEQ ID NO: 12468 - RNA, 1725 nt, synthetic construct
  misc_feature 1..1725: note = derived and/or modified CDS sequence (opt3) from HRSV(Memphis-37)__AIY60640.1__F0_DSCav1
  source 1..1725: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactga

SEQ ID NO: 12469 - RNA, 1725 nt, synthetic construct
  misc_feature 1..1725: note = derived and/or modified CDS sequence (opt4) from HRSV(Memphis-37)__AIY60640.1__F0_DSCav1
  source 1..1725: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactga

SEQ ID NO: 12470 - RNA, 1725 nt, synthetic construct
  misc_feature 1..1725: note = derived and/or modified CDS sequence (opt5) from HRSV(Memphis-37)__AIY60640.1__F0_DSCav1
  source 1..1725: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactga

SEQ ID NO: 12471 - RNA, 1725 nt, synthetic construct
  misc_feature 1..1725: note = derived and/or modified CDS sequence (opt6) from HRSV(Memphis-37)__AIY60640.1__F0_DSCav1
  source 1..1725: mol_type = other RNA
atggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaa

SEQ ID NO: 12472 - RNA, 1725 nt, synthetic construct
  misc_feature 1..1725: note = derived and/or modified CDS sequence (opt11) from HRSV(Memphis-37)__AIY60640.1__F0_DSCav1
  source 1..1725: mol_type = other RNA
atggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaa

SEQ ID NO: 12473 - RNA, 2001 nt, synthetic construct
  misc_feature 1..2001: note = mRNA product Design a-1 comprising derived and/or modified sequence from HRSV(Memphis-37)__AIY60640.1__F0_DSCav1 (opt1)
  source 1..2001: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12474 - RNA, 2001 nt, synthetic construct
  misc_feature 1..2001: note = mRNA product Design a-1 comprising derived and/or modified sequence from HRSV(Memphis-37)__AIY60640.1__F0_DSCav1 (opt1)
  source 1..2001: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12475 - RNA, 2001 nt, synthetic construct
  misc_feature 1..2001: note = mRNA product Design a-1 comprising derived and/or modified sequence from HRSV(Memphis-37)__AIY60640.1__F0_DSCav1 (opt2)
  source 1..2001: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12476 - RNA, 2001 nt, synthetic construct
  misc_feature 1..2001: note = mRNA product Design a-1 comprising derived and/or modified sequence from HRSV(Memphis-37)__AIY60640.1__F0_DSCav1 (opt3)
  source 1..2001: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12477 - RNA, 2001 nt, synthetic construct
  misc_feature 1..2001: note = mRNA product Design a-1 comprising derived and/or modified sequence from HRSV(Memphis-37)__AIY60640.1__F0_DSCav1 (opt4)
  source 1..2001: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12478 - RNA, 2001 nt, synthetic construct
  misc_feature 1..2001: note = mRNA product Design a-1 comprising derived and/or modified sequence from HRSV(Memphis-37)__AIY60640.1__F0_DSCav1 (opt5)
  source 1..2001: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12479 - RNA, 2001 nt, synthetic construct
  misc_feature 1..2001: note = mRNA product Design a-1 comprising derived and/or modified sequence from HRSV(Memphis-37)__AIY60640.1__F0_DSCav1 (opt6)
  source 1..2001: mol_type = other RNA
gggagagtcccgcagtcggcgtccagcggctctgcttgttcgtgtgtgtgtcgttgcaggccttattcaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12480 - RNA, 2001 nt, synthetic construct
  misc_feature 1..2001: note = mRNA product Design a-1 comprising derived and/or modified sequence from HRSV(Memphis-37)__AIY60640.1__F0_DSCav1 (opt11)
  source 1..2001: mol_type = other RNA
gggagagtcccgcagtcggcgtccagcggctctgcttgttcgtgtgtgtgtcgttgcaggccttattcaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12481 - RNA, 2020 nt, synthetic construct
  misc_feature 1..2020: note = mRNA product Design a-2 comprising derived and/or modified sequence from HRSV(Memphis-37)__AIY60640.1__F0_DSCav1 (opt1)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12482 - RNA, 2020 nt, synthetic construct
  misc_feature 1..2020: note = mRNA product Design a-2 comprising derived and/or modified sequence from HRSV(Memphis-37)__AIY60640.1__F0_DSCav1 (opt1)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12483 - RNA, 2020 nt, synthetic construct
  misc_feature 1..2020: note = mRNA product Design a-2 comprising derived and/or modified sequence from HRSV(Memphis-37)__AIY60640.1__F0_DSCav1 (opt2)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12484 - RNA, 2020 nt, synthetic construct
  misc_feature 1..2020: note = mRNA product Design a-2 comprising derived and/or modified sequence from HRSV(Memphis-37)__AIY60640.1__F0_DSCav1 (opt3)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12485 - RNA, 2020 nt, synthetic construct
  misc_feature 1..2020: note = mRNA product Design a-2 comprising derived and/or modified sequence from HRSV(Memphis-37)__AIY60640.1__F0_DSCav1 (opt4)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12486 - RNA, 2020 nt, synthetic construct
  misc_feature 1..2020: note = mRNA product Design a-2 comprising derived and/or modified sequence from HRSV(Memphis-37)__AIY60640.1__F0_DSCav1 (opt5)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12487 - RNA, 2020 nt, synthetic construct
  misc_feature 1..2020: note = mRNA product Design a-2 comprising derived and/or modified sequence from HRSV(Memphis-37)__AIY60640.1__F0_DSCav1 (opt6)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12488 - RNA, 2020 nt, synthetic construct
  misc_feature 1..2020: note = mRNA product Design a-2 comprising derived and/or modified sequence from HRSV(Memphis-37)__AIY60640.1__F0_DSCav1 (opt11)
  source 1..2020: mol_type = other RNA
gggagagtccgctcagccaggttgcagaagcggcttagcgtgtgtcctaatcttctctctgcgtgtaggtaggcctgtgccgcaaacaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12489 - RNA, 2098 nt, synthetic construct
  misc_feature 1..2098: note = mRNA product Design a-3 comprising derived and/or modified sequence from HRSV(Memphis-37)__AIY60640.1__F0_DSCav1 (opt1)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12490 - RNA, 2098 nt, synthetic construct
  misc_feature 1..2098: note = mRNA product Design a-3 comprising derived and/or modified sequence from HRSV(Memphis-37)__AIY60640.1__F0_DSCav1 (opt1)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12491 - RNA, 2098 nt, synthetic construct
  misc_feature 1..2098: note = mRNA product Design a-3 comprising derived and/or modified sequence from HRSV(Memphis-37)__AIY60640.1__F0_DSCav1 (opt2)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12492 - RNA, 2098 nt, synthetic construct
  misc_feature 1..2098: note = mRNA product Design a-3 comprising derived and/or modified sequence from HRSV(Memphis-37)__AIY60640.1__F0_DSCav1 (opt3)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12493 - RNA, 2098 nt, synthetic construct
  misc_feature 1..2098: note = mRNA product Design a-3 comprising derived and/or modified sequence from HRSV(Memphis-37)__AIY60640.1__F0_DSCav1 (opt4)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12494 - RNA, 2098 nt, synthetic construct
  misc_feature 1..2098: note = mRNA product Design a-3 comprising derived and/or modified sequence from HRSV(Memphis-37)__AIY60640.1__F0_DSCav1 (opt5)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12495 - RNA, 2098 nt, synthetic construct
  misc_feature 1..2098: note = mRNA product Design a-3 comprising derived and/or modified sequence from HRSV(Memphis-37)__AIY60640.1__F0_DSCav1 (opt6)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12496 - RNA, 2098 nt, synthetic construct
  misc_feature 1..2098: note = mRNA product Design a-3 comprising derived and/or modified sequence from HRSV(Memphis-37)__AIY60640.1__F0_DSCav1 (opt11)
  source 1..2098: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12497 - RNA, 2047 nt, synthetic construct
  misc_feature 1..2047: note = mRNA product Design a-4 comprising derived and/or modified sequence from HRSV(Memphis-37)__AIY60640.1__F0_DSCav1 (opt1)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12498 - RNA, 2047 nt, synthetic construct
  misc_feature 1..2047: note = mRNA product Design a-4 comprising derived and/or modified sequence from HRSV(Memphis-37)__AIY60640.1__F0_DSCav1 (opt1)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12499 - RNA, 2047 nt, synthetic construct
  misc_feature 1..2047: note = mRNA product Design a-4 comprising derived and/or modified sequence from HRSV(Memphis-37)__AIY60640.1__F0_DSCav1 (opt2)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12500 - RNA, 2047 nt, synthetic construct
  misc_feature 1..2047: note = mRNA product Design a-4 comprising derived and/or modified sequence from HRSV(Memphis-37)__AIY60640.1__F0_DSCav1 (opt3)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12501 - RNA, 2047 nt, synthetic construct
  misc_feature 1..2047: note = mRNA product Design a-4 comprising derived and/or modified sequence from HRSV(Memphis-37)__AIY60640.1__F0_DSCav1 (opt4)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12502 - RNA, 2047 nt, synthetic construct
  misc_feature 1..2047: note = mRNA product Design a-4 comprising derived and/or modified sequence from HRSV(Memphis-37)__AIY60640.1__F0_DSCav1 (opt5)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12503 - RNA, 2047 nt, synthetic construct
  misc_feature 1..2047: note = mRNA product Design a-4 comprising derived and/or modified sequence from HRSV(Memphis-37)__AIY60640.1__F0_DSCav1 (opt6)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12504 - RNA, 2047 nt, synthetic construct
  misc_feature 1..2047: note = mRNA product Design a-4 comprising derived and/or modified sequence from HRSV(Memphis-37)__AIY60640.1__F0_DSCav1 (opt11)
  source 1..2047: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12505 - RNA, 1993 nt, synthetic construct
  misc_feature 1..1993: note = mRNA product Design a-5 comprising derived and/or modified sequence from HRSV(Memphis-37)__AIY60640.1__F0_DSCav1 (opt1)
  source 1..1993: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12506 - RNA, 1993 nt, synthetic construct
  misc_feature 1..1993: note = mRNA product Design a-5 comprising derived and/or modified sequence from HRSV(Memphis-37)__AIY60640.1__F0_DSCav1 (opt1)
  source 1..1993: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12507 - RNA, 1993 nt, synthetic construct
  misc_feature 1..1993: note = mRNA product Design a-5 comprising derived and/or modified sequence from HRSV(Memphis-37)__AIY60640.1__F0_DSCav1 (opt2)
  source 1..1993: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12508 - RNA, 1993 nt, synthetic construct
  misc_feature 1..1993: note = mRNA product Design a-5 comprising derived and/or modified sequence from HRSV(Memphis-37)__AIY60640.1__F0_DSCav1 (opt3)
  source 1..1993: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12509 - RNA, 1993 nt, synthetic construct
  misc_feature 1..1993: note = mRNA product Design a-5 comprising derived and/or modified sequence from HRSV(Memphis-37)__AIY60640.1__F0_DSCav1 (opt4)
  source 1..1993: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12510 - RNA, 1993 nt, synthetic construct
  misc_feature 1..1993: note = mRNA product Design a-5 comprising derived and/or modified sequence from HRSV(Memphis-37)__AIY60640.1__F0_DSCav1 (opt5)
  source 1..1993: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12511 - RNA, 1993 nt, synthetic construct
  misc_feature 1..1993: note = mRNA product Design a-5 comprising derived and/or modified sequence from HRSV(Memphis-37)__AIY60640.1__F0_DSCav1 (opt6)
  source 1..1993: mol_type = other RNA
gggagactttcccattctgtagcagaatttggtgttgcctgtggtcttggtcccgcggagaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12512 - RNA, 1993 nt, synthetic construct
  misc_feature 1..1993: note = mRNA product Design a-5 comprising derived and/or modified sequence from HRSV(Memphis-37)__AIY60640.1__F0_DSCav1 (opt11)
  source 1..1993: mol_type = other RNA
gggagactttcccattctgtagcagaatttggtgttgcctgtggtcttggtcccgcggagaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12513 - RNA, 2174 nt, synthetic construct
  misc_feature 1..2174: note = mRNA product Design b-1 comprising derived and/or modified sequence from HRSV(Memphis-37)__AIY60640.1__F0_DSCav1 (opt1)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12514 - RNA, 2174 nt, synthetic construct
  misc_feature 1..2174: note = mRNA product Design b-1 comprising derived and/or modified sequence from HRSV(Memphis-37)__AIY60640.1__F0_DSCav1 (opt1)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12515 - RNA, 2174 nt, synthetic construct
  misc_feature 1..2174: note = mRNA product Design b-1 comprising derived and/or modified sequence from HRSV(Memphis-37)__AIY60640.1__F0_DSCav1 (opt2)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12516 - RNA, 2174 nt, synthetic construct
  misc_feature 1..2174: note = mRNA product Design b-1 comprising derived and/or modified sequence from HRSV(Memphis-37)__AIY60640.1__F0_DSCav1 (opt3)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12517 - RNA, 2174 nt, synthetic construct
  misc_feature 1..2174: note = mRNA product Design b-1 comprising derived and/or modified sequence from HRSV(Memphis-37)__AIY60640.1__F0_DSCav1 (opt4)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12518 - RNA, 2174 nt, synthetic construct
  misc_feature 1..2174: note = mRNA product Design b-1 comprising derived and/or modified sequence from HRSV(Memphis-37)__AIY60640.1__F0_DSCav1 (opt5)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12519 - RNA, 2174 nt, synthetic construct
  misc_feature 1..2174: note = mRNA product Design b-1 comprising derived and/or modified sequence from HRSV(Memphis-37)__AIY60640.1__F0_DSCav1 (opt6)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12520 - RNA, 2174 nt, synthetic construct
  misc_feature 1..2174: note = mRNA product Design b-1 comprising derived and/or modified sequence from HRSV(Memphis-37)__AIY60640.1__F0_DSCav1 (opt11)
  source 1..2174: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12521 - RNA, 1994 nt, synthetic construct
  misc_feature 1..1994: note = mRNA product Design b-2 comprising derived and/or modified sequence from HRSV(Memphis-37)__AIY60640.1__F0_DSCav1 (opt1)
  source 1..1994: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12522 - RNA, 1994 nt, synthetic construct
  misc_feature 1..1994: note = mRNA product Design b-2 comprising derived and/or modified sequence from HRSV(Memphis-37)__AIY60640.1__F0_DSCav1 (opt1)
  source 1..1994: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12523 - RNA, 1994 nt, synthetic construct
  misc_feature 1..1994: note = mRNA product Design b-2 comprising derived and/or modified sequence from HRSV(Memphis-37)__AIY60640.1__F0_DSCav1 (opt2)
  source 1..1994: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12524 - RNA, 1994 nt, synthetic construct
  misc_feature 1..1994: note = mRNA product Design b-2 comprising derived and/or modified sequence from HRSV(Memphis-37)__AIY60640.1__F0_DSCav1 (opt3)
  source 1..1994: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12525 - RNA, 1994 nt, synthetic construct
  misc_feature 1..1994: note = mRNA product Design b-2 comprising derived and/or modified sequence from HRSV(Memphis-37)__AIY60640.1__F0_DSCav1 (opt4)
  source 1..1994: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12526 - RNA, 1994 nt, synthetic construct
  misc_feature 1..1994: note = mRNA product Design b-2 comprising derived and/or modified sequence from HRSV(Memphis-37)__AIY60640.1__F0_DSCav1 (opt5)
  source 1..1994: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12527 - RNA, 1994 nt, synthetic construct
  misc_feature 1..1994: note = mRNA product Design b-2 comprising derived and/or modified sequence from HRSV(Memphis-37)__AIY60640.1__F0_DSCav1 (opt6)
  source 1..1994: mol_type = other RNA
gggagagcctctgctggagtccggggagtggcgttggctgctagagcgaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12528 - RNA, 1994 nt, synthetic construct
  misc_feature 1..1994: note = mRNA product Design b-2 comprising derived and/or modified sequence from HRSV(Memphis-37)__AIY60640.1__F0_DSCav1 (opt11)
  source 1..1994: mol_type = other RNA
gggagagcctctgctggagtccggggagtggcgttggctgctagagcgaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12529 - RNA, 2014 nt, synthetic construct
  misc_feature 1..2014: note = mRNA product Design b-3 comprising derived and/or modified sequence from HRSV(Memphis-37)__AIY60640.1__F0_DSCav1 (opt1)
  source 1..2014: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12530 - RNA, 2014 nt, synthetic construct
  misc_feature 1..2014: note = mRNA product Design b-3 comprising derived and/or modified sequence from HRSV(Memphis-37)__AIY60640.1__F0_DSCav1 (opt1)
  source 1..2014: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12531 - RNA, 2014 nt, synthetic construct
  misc_feature 1..2014: note = mRNA product Design b-3 comprising derived and/or modified sequence from HRSV(Memphis-37)__AIY60640.1__F0_DSCav1 (opt2)
  source 1..2014: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12532 - RNA, 2014 nt, synthetic construct
  misc_feature 1..2014: note = mRNA product Design b-3 comprising derived and/or modified sequence from HRSV(Memphis-37)__AIY60640.1__F0_DSCav1 (opt3)
  source 1..2014: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12533 - RNA, 2014 nt, synthetic construct
  misc_feature 1..2014: note = mRNA product Design b-3 comprising derived and/or modified sequence from HRSV(Memphis-37)__AIY60640.1__F0_DSCav1 (opt4)
  source 1..2014: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12534 - RNA, 2014 nt, synthetic construct
  misc_feature 1..2014: note = mRNA product Design b-3 comprising derived and/or modified sequence from HRSV(Memphis-37)__AIY60640.1__F0_DSCav1 (opt5)
  source 1..2014: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12535 - RNA, 2014 nt, synthetic construct
  misc_feature 1..2014: note = mRNA product Design b-3 comprising derived and/or modified sequence from HRSV(Memphis-37)__AIY60640.1__F0_DSCav1 (opt6)
  source 1..2014: mol_type = other RNA
gggagagtcccgcagtcggcgtccagcggctctgcttgttcgtgtgtgtgtcgttgcaggccttattcaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12536 - RNA, 2014 nt, synthetic construct
  misc_feature 1..2014: note = mRNA product Design b-3 comprising derived and/or modified sequence from HRSV(Memphis-37)__AIY60640.1__F0_DSCav1 (opt11)
  source 1..2014: mol_type = other RNA
gggagagtcccgcagtcggcgtccagcggctctgcttgttcgtgtgtgtgtcgttgcaggccttattcaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12537 - RNA, 2065 nt, synthetic construct
  misc_feature 1..2065: note = mRNA product Design b-4 comprising derived and/or modified sequence from HRSV(Memphis-37)__AIY60640.1__F0_DSCav1 (opt1)
  source 1..2065: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12538 - RNA, 2065 nt, synthetic construct
  misc_feature 1..2065: note = mRNA product Design b-4 comprising derived and/or modified sequence from HRSV(Memphis-37)__AIY60640.1__F0_DSCav1 (opt1)
  source 1..2065: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12539 - RNA, 2065 nt, synthetic construct
  misc_feature 1..2065: note = mRNA product Design b-4 comprising derived and/or modified sequence from HRSV(Memphis-37)__AIY60640.1__F0_DSCav1 (opt2)
  source 1..2065: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12540 - RNA, 2065 nt, synthetic construct
  misc_feature 1..2065: note = mRNA product Design b-4 comprising derived and/or modified sequence from HRSV(Memphis-37)__AIY60640.1__F0_DSCav1 (opt3)
  source 1..2065: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12541 - RNA, 2065 nt, synthetic construct
  misc_feature 1..2065: note = mRNA product Design b-4 comprising derived and/or modified sequence from HRSV(Memphis-37)__AIY60640.1__F0_DSCav1 (opt4)
  source 1..2065: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12542 - RNA, 2065 nt, synthetic construct
  misc_feature 1..2065: note = mRNA product Design b-4 comprising derived and/or modified sequence from HRSV(Memphis-37)__AIY60640.1__F0_DSCav1 (opt5)
  source 1..2065: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12543 - RNA, 2065 nt, synthetic construct
  misc_feature 1..2065: note = mRNA product Design b-4 comprising derived and/or modified sequence from HRSV(Memphis-37)__AIY60640.1__F0_DSCav1 (opt6)
  source 1..2065: mol_type = other RNA
gggagagtcccgcagtcggcgtccagcggctctgcttgttcgtgtgtgtgtcgttgcaggccttattcaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12544 - RNA, 2065 nt, synthetic construct
  misc_feature 1..2065: note = mRNA product Design b-4 comprising derived and/or modified sequence from HRSV(Memphis-37)__AIY60640.1__F0_DSCav1 (opt11)
  source 1..2065: mol_type = other RNA
gggagagtcccgcagtcggcgtccagcggctctgcttgttcgtgtgtgtgtcgttgcaggccttattcaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12545 - RNA, 2127 nt, synthetic construct
  misc_feature 1..2127: note = mRNA product Design b-5 comprising derived and/or modified sequence from HRSV(Memphis-37)__AIY60640.1__F0_DSCav1 (opt1)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12546 - RNA, 2127 nt, synthetic construct
  misc_feature 1..2127: note = mRNA product Design b-5 comprising derived and/or modified sequence from HRSV(Memphis-37)__AIY60640.1__F0_DSCav1 (opt1)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12547 - RNA, 2127 nt, synthetic construct
  misc_feature 1..2127: note = mRNA product Design b-5 comprising derived and/or modified sequence from HRSV(Memphis-37)__AIY60640.1__F0_DSCav1 (opt2)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12548 - RNA, 2127 nt, synthetic construct
  misc_feature 1..2127: note = mRNA product Design b-5 comprising derived and/or modified sequence from HRSV(Memphis-37)__AIY60640.1__F0_DSCav1 (opt3)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12549 - RNA, 2127 nt, synthetic construct
  misc_feature 1..2127: note = mRNA product Design b-5 comprising derived and/or modified sequence from HRSV(Memphis-37)__AIY60640.1__F0_DSCav1 (opt4)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12550 - RNA, 2127 nt, synthetic construct
  misc_feature 1..2127: note = mRNA product Design b-5 comprising derived and/or modified sequence from HRSV(Memphis-37)__AIY60640.1__F0_DSCav1 (opt5)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12551 - RNA, 2127 nt, synthetic construct
  misc_feature 1..2127: note = mRNA product Design b-5 comprising derived and/or modified sequence from HRSV(Memphis-37)__AIY60640.1__F0_DSCav1 (opt6)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12552 - RNA, 2127 nt, synthetic construct
  misc_feature 1..2127: note = mRNA product Design b-5 comprising derived and/or modified sequence from HRSV(Memphis-37)__AIY60640.1__F0_DSCav1 (opt11)
  source 1..2127: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12553 - RNA, 2033 nt, synthetic construct
  misc_feature 1..2033: note = mRNA product Design c-1 comprising derived and/or modified sequence from HRSV(Memphis-37)__AIY60640.1__F0_DSCav1 (opt1)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12554 - RNA, 2033 nt, synthetic construct
  misc_feature 1..2033: note = mRNA product Design c-1 comprising derived and/or modified sequence from HRSV(Memphis-37)__AIY60640.1__F0_DSCav1 (opt1)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12555 - RNA, 2033 nt, synthetic construct
  misc_feature 1..2033: note = mRNA product Design c-1 comprising derived and/or modified sequence from HRSV(Memphis-37)__AIY60640.1__F0_DSCav1 (opt2)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12556 - RNA, 2033 nt, synthetic construct
  misc_feature 1..2033: note = mRNA product Design c-1 comprising derived and/or modified sequence from HRSV(Memphis-37)__AIY60640.1__F0_DSCav1 (opt3)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12557 - RNA, 2033 nt, synthetic construct
  misc_feature 1..2033: note = mRNA product Design c-1 comprising derived and/or modified sequence from HRSV(Memphis-37)__AIY60640.1__F0_DSCav1 (opt4)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12558 - RNA, 2033 nt, synthetic construct
  misc_feature 1..2033: note = mRNA product Design c-1 comprising derived and/or modified sequence from HRSV(Memphis-37)__AIY60640.1__F0_DSCav1 (opt5)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12559 - RNA, 2033 nt, synthetic construct
  misc_feature 1..2033: note = mRNA product Design c-1 comprising derived and/or modified sequence from HRSV(Memphis-37)__AIY60640.1__F0_DSCav1 (opt6)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12560 - RNA, 2033 nt, synthetic construct
  misc_feature 1..2033: note = mRNA product Design c-1 comprising derived and/or modified sequence from HRSV(Memphis-37)__AIY60640.1__F0_DSCav1 (opt11)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12561 - RNA, 2123 nt, synthetic construct
  misc_feature 1..2123: note = mRNA product Design c-2 comprising derived and/or modified sequence from HRSV(Memphis-37)__AIY60640.1__F0_DSCav1 (opt1)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12562 - RNA, 2123 nt, synthetic construct
  misc_feature 1..2123: note = mRNA product Design c-2 comprising derived and/or modified sequence from HRSV(Memphis-37)__AIY60640.1__F0_DSCav1 (opt1)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12563 - RNA, 2123 nt, synthetic construct
  misc_feature 1..2123: note = mRNA product Design c-2 comprising derived and/or modified sequence from HRSV(Memphis-37)__AIY60640.1__F0_DSCav1 (opt2)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12564 - RNA, 2123 nt, synthetic construct
  misc_feature 1..2123: note = mRNA product Design c-2 comprising derived and/or modified sequence from HRSV(Memphis-37)__AIY60640.1__F0_DSCav1 (opt3)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12565 - RNA, 2123 nt, synthetic construct
  misc_feature 1..2123: note = mRNA product Design c-2 comprising derived and/or modified sequence from HRSV(Memphis-37)__AIY60640.1__F0_DSCav1 (opt4)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12566 - RNA, 2123 nt, synthetic construct
  misc_feature 1..2123: note = mRNA product Design c-2 comprising derived and/or modified sequence from HRSV(Memphis-37)__AIY60640.1__F0_DSCav1 (opt5)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12567 - RNA, 2123 nt, synthetic construct
  misc_feature 1..2123: note = mRNA product Design c-2 comprising derived and/or modified sequence from HRSV(Memphis-37)__AIY60640.1__F0_DSCav1 (opt6)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12568 - RNA, 2123 nt, synthetic construct
  misc_feature 1..2123: note = mRNA product Design c-2 comprising derived and/or modified sequence from HRSV(Memphis-37)__AIY60640.1__F0_DSCav1 (opt11)
  source 1..2123: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12569 - RNA, 2100 nt, synthetic construct
  misc_feature 1..2100: note = mRNA product Design c-3 comprising derived and/or modified sequence from HRSV(Memphis-37)__AIY60640.1__F0_DSCav1 (opt1)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12570 - RNA, 2100 nt, synthetic construct
  misc_feature 1..2100: note = mRNA product Design c-3 comprising derived and/or modified sequence from HRSV(Memphis-37)__AIY60640.1__F0_DSCav1 (opt1)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12571 - RNA, 2100 nt, synthetic construct
  misc_feature 1..2100: note = mRNA product Design c-3 comprising derived and/or modified sequence from HRSV(Memphis-37)__AIY60640.1__F0_DSCav1 (opt2)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12572 - RNA, 2100 nt, synthetic construct
  misc_feature 1..2100: note = mRNA product Design c-3 comprising derived and/or modified sequence from HRSV(Memphis-37)__AIY60640.1__F0_DSCav1 (opt3)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12573 - RNA, 2100 nt, synthetic construct
  misc_feature 1..2100: note = mRNA product Design c-3 comprising derived and/or modified sequence from HRSV(Memphis-37)__AIY60640.1__F0_DSCav1 (opt4)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12574 - RNA, 2100 nt, synthetic construct
  misc_feature 1..2100: note = mRNA product Design c-3 comprising derived and/or modified sequence from HRSV(Memphis-37)__AIY60640.1__F0_DSCav1 (opt5)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12575 - RNA, 2100 nt, synthetic construct
  misc_feature 1..2100: note = mRNA product Design c-3 comprising derived and/or modified sequence from HRSV(Memphis-37)__AIY60640.1__F0_DSCav1 (opt6)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12576 - RNA, 2100 nt, synthetic construct
  misc_feature 1..2100: note = mRNA product Design c-3 comprising derived and/or modified sequence from HRSV(Memphis-37)__AIY60640.1__F0_DSCav1 (opt11)
  source 1..2100: mol_type = other RNA
gggagagtccgctcagccaggttgcagaagcggcttagcgtgtgtcctaatcttctctctgcgtgtaggtaggcctgtgccgcaaacaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12577 - RNA, 2096 nt, synthetic construct
  misc_feature 1..2096: note = mRNA product Design c-4 comprising derived and/or modified sequence from HRSV(Memphis-37)__AIY60640.1__F0_DSCav1 (opt1)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12578 - RNA, 2096 nt, synthetic construct
  misc_feature 1..2096: note = mRNA product Design c-4 comprising derived and/or modified sequence from HRSV(Memphis-37)__AIY60640.1__F0_DSCav1 (opt1)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12579 - RNA, 2096 nt, synthetic construct
  misc_feature 1..2096: note = mRNA product Design c-4 comprising derived and/or modified sequence from HRSV(Memphis-37)__AIY60640.1__F0_DSCav1 (opt2)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12580 - RNA, 2096 nt, synthetic construct
  misc_feature 1..2096: note = mRNA product Design c-4 comprising derived and/or modified sequence from HRSV(Memphis-37)__AIY60640.1__F0_DSCav1 (opt3)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12581 - RNA, 2096 nt, synthetic construct
  misc_feature 1..2096: note = mRNA product Design c-4 comprising derived and/or modified sequence from HRSV(Memphis-37)__AIY60640.1__F0_DSCav1 (opt4)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12582 - RNA, 2096 nt, synthetic construct
  misc_feature 1..2096: note = mRNA product Design c-4 comprising derived and/or modified sequence from HRSV(Memphis-37)__AIY60640.1__F0_DSCav1 (opt5)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12583 - RNA, 2096 nt, synthetic construct
  misc_feature 1..2096: note = mRNA product Design c-4 comprising derived and/or modified sequence from HRSV(Memphis-37)__AIY60640.1__F0_DSCav1 (opt6)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12584 - RNA, 2096 nt, synthetic construct
  misc_feature 1..2096: note = mRNA product Design c-4 comprising derived and/or modified sequence from HRSV(Memphis-37)__AIY60640.1__F0_DSCav1 (opt11)
  source 1..2096: mol_type = other RNA
gggagagtccgctcagccaggttgcagaagcggcttagcgtgtgtcctaatcttctctctgcgtgtaggtaggcctgtgccgcaaacaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12585 - RNA, 2014 nt, synthetic construct
  misc_feature 1..2014: note = mRNA product Design c-5 comprising derived and/or modified sequence from HRSV(Memphis-37)__AIY60640.1__F0_DSCav1 (opt1)
  source 1..2014: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12586 - RNA, 2014 nt, synthetic construct
  misc_feature 1..2014: note = mRNA product Design c-5 comprising derived and/or modified sequence from HRSV(Memphis-37)__AIY60640.1__F0_DSCav1 (opt1)
  source 1..2014: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12587 - RNA, 2014 nt, synthetic construct
  misc_feature 1..2014: note = mRNA product Design c-5 comprising derived and/or modified sequence from HRSV(Memphis-37)__AIY60640.1__F0_DSCav1 (opt2)
  source 1..2014: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12588 - RNA, 2014 nt, synthetic construct
  misc_feature 1..2014: note = mRNA product Design c-5 comprising derived and/or modified sequence from HRSV(Memphis-37)__AIY60640.1__F0_DSCav1 (opt3)
  source 1..2014: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12589 - RNA, 2014 nt, synthetic construct
  misc_feature 1..2014: note = mRNA product Design c-5 comprising derived and/or modified sequence from HRSV(Memphis-37)__AIY60640.1__F0_DSCav1 (opt4)
  source 1..2014: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12590 - RNA, 2014 nt, synthetic construct
  misc_feature 1..2014: note = mRNA product Design c-5 comprising derived and/or modified sequence from HRSV(Memphis-37)__AIY60640.1__F0_DSCav1 (opt5)
  source 1..2014: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12591 - RNA, 2014 nt, synthetic construct
  misc_feature 1..2014: note = mRNA product Design c-5 comprising derived and/or modified sequence from HRSV(Memphis-37)__AIY60640.1__F0_DSCav1 (opt6)
  source 1..2014: mol_type = other RNA
gggagagcggctcggccattttgtcccagtcagtccggaggctgcggctgcagaagtaccgcctgcggagtaactgcaaagaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12592 - RNA, 2014 nt, synthetic construct
  misc_feature 1..2014: note = mRNA product Design c-5 comprising derived and/or modified sequence from HRSV(Memphis-37)__AIY60640.1__F0_DSCav1 (opt11)
  source 1..2014: mol_type = other RNA
gggagagcggctcggccattttgtcccagtcagtccggaggctgcggctgcagaagtaccgcctgcggagtaactgcaaagaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12593 - RNA, 2023 nt, synthetic construct
  misc_feature 1..2023: note = mRNA product Design d-1 comprising derived and/or modified sequence from HRSV(Memphis-37)__AIY60640.1__F0_DSCav1 (opt1)
  source 1..2023: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12594 - RNA, 2023 nt, synthetic construct
  misc_feature 1..2023: note = mRNA product Design d-1 comprising derived and/or modified sequence from HRSV(Memphis-37)__AIY60640.1__F0_DSCav1 (opt1)
  source 1..2023: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12595 - RNA, 2023 nt, synthetic construct
  misc_feature 1..2023: note = mRNA product Design d-1 comprising derived and/or modified sequence from HRSV(Memphis-37)__AIY60640.1__F0_DSCav1 (opt2)
  source 1..2023: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12596 - RNA, 2023 nt, synthetic construct
  misc_feature 1..2023: note = mRNA product Design d-1 comprising derived and/or modified sequence from HRSV(Memphis-37)__AIY60640.1__F0_DSCav1 (opt3)
  source 1..2023: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12597 - RNA, 2023 nt, synthetic construct
  misc_feature 1..2023: note = mRNA product Design d-1 comprising derived and/or modified sequence from HRSV(Memphis-37)__AIY60640.1__F0_DSCav1 (opt4)
  source 1..2023: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12598 - RNA, 2023 nt, synthetic construct
  misc_feature 1..2023: note = mRNA product Design d-1 comprising derived and/or modified sequence from HRSV(Memphis-37)__AIY60640.1__F0_DSCav1 (opt5)
  source 1..2023: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12599 - RNA, 2023 nt, synthetic construct
  misc_feature 1..2023: note = mRNA product Design d-1 comprising derived and/or modified sequence from HRSV(Memphis-37)__AIY60640.1__F0_DSCav1 (opt6)
  source 1..2023: mol_type = other RNA
gggagacccgtgacccggaagttgtacggctacgcgactttccctcccacaaaccctcgcgcccttcctttcctacttgggcccggcagaaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12600 - RNA, 2023 nt, synthetic construct
  misc_feature 1..2023: note = mRNA product Design d-1 comprising derived and/or modified sequence from HRSV(Memphis-37)__AIY60640.1__F0_DSCav1 (opt11)
  source 1..2023: mol_type = other RNA
gggagacccgtgacccggaagttgtacggctacgcgactttccctcccacaaaccctcgcgcccttcctttcctacttgggcccggcagaaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12601 - RNA, 2078 nt, synthetic construct
  misc_feature 1..2078: note = mRNA product Design d-2 comprising derived and/or modified sequence from HRSV(Memphis-37)__AIY60640.1__F0_DSCav1 (opt1)
  source 1..2078: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12602 - RNA, 2078 nt, synthetic construct
  misc_feature 1..2078: note = mRNA product Design d-2 comprising derived and/or modified sequence from HRSV(Memphis-37)__AIY60640.1__F0_DSCav1 (opt1)
  source 1..2078: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12603 - RNA, 2078 nt, synthetic construct
  misc_feature 1..2078: note = mRNA product Design d-2 comprising derived and/or modified sequence from HRSV(Memphis-37)__AIY60640.1__F0_DSCav1 (opt2)
  source 1..2078: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12604 - RNA, 2078 nt, synthetic construct
  misc_feature 1..2078: note = mRNA product Design d-2 comprising derived and/or modified sequence from HRSV(Memphis-37)__AIY60640.1__F0_DSCav1 (opt3)
  source 1..2078: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12605 - RNA, 2078 nt, synthetic construct
  misc_feature 1..2078: note = mRNA product Design d-2 comprising derived and/or modified sequence from HRSV(Memphis-37)__AIY60640.1__F0_DSCav1 (opt4)
  source 1..2078: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12606 - RNA, 2078 nt, synthetic construct
  misc_feature 1..2078: note = mRNA product Design d-2 comprising derived and/or modified sequence from HRSV(Memphis-37)__AIY60640.1__F0_DSCav1 (opt5)
  source 1..2078: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12607 - RNA, 2078 nt, synthetic construct
  misc_feature 1..2078: note = mRNA product Design d-2 comprising derived and/or modified sequence from HRSV(Memphis-37)__AIY60640.1__F0_DSCav1 (opt6)
  source 1..2078: mol_type = other RNA
gggagagcggctcggccattttgtcccagtcagtccggaggctgcggctgcagaagtaccgcctgcggagtaactgcaaagaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12608 - RNA, 2078 nt, synthetic construct
  misc_feature 1..2078: note = mRNA product Design d-2 comprising derived and/or modified sequence from HRSV(Memphis-37)__AIY60640.1__F0_DSCav1 (opt11)
  source 1..2078: mol_type = other RNA
gggagagcggctcggccattttgtcccagtcagtccggaggctgcggctgcagaagtaccgcctgcggagtaactgcaaagaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12609 - RNA, 2394 nt, synthetic construct
  misc_feature 1..2394: note = mRNA product Design d-3 comprising derived and/or modified sequence from HRSV(Memphis-37)__AIY60640.1__F0_DSCav1 (opt1)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12610 - RNA, 2394 nt, synthetic construct
  misc_feature 1..2394: note = mRNA product Design d-3 comprising derived and/or modified sequence from HRSV(Memphis-37)__AIY60640.1__F0_DSCav1 (opt1)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12611 - RNA, 2394 nt, synthetic construct
  misc_feature 1..2394: note = mRNA product Design d-3 comprising derived and/or modified sequence from HRSV(Memphis-37)__AIY60640.1__F0_DSCav1 (opt2)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12612 - RNA, 2394 nt, synthetic construct
  misc_feature 1..2394: note = mRNA product Design d-3 comprising derived and/or modified sequence from HRSV(Memphis-37)__AIY60640.1__F0_DSCav1 (opt3)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12613 - RNA, 2394 nt, synthetic construct
  misc_feature 1..2394: note = mRNA product Design d-3 comprising derived and/or modified sequence from HRSV(Memphis-37)__AIY60640.1__F0_DSCav1 (opt4)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12614 - RNA, 2394 nt, synthetic construct
  misc_feature 1..2394: note = mRNA product Design d-3 comprising derived and/or modified sequence from HRSV(Memphis-37)__AIY60640.1__F0_DSCav1 (opt5)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12615 - RNA, 2394 nt, synthetic construct
  misc_feature 1..2394: note = mRNA product Design d-3 comprising derived and/or modified sequence from HRSV(Memphis-37)__AIY60640.1__F0_DSCav1 (opt6)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12616 - RNA, 2394 nt, synthetic construct
  misc_feature 1..2394: note = mRNA product Design d-3 comprising derived and/or modified sequence from HRSV(Memphis-37)__AIY60640.1__F0_DSCav1 (opt11)
  source 1..2394: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12617 - RNA, 2077 nt, synthetic construct
  misc_feature 1..2077: note = mRNA product Design d-4 comprising derived and/or modified sequence from HRSV(Memphis-37)__AIY60640.1__F0_DSCav1 (opt1)
  source 1..2077: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12618 - RNA, 2077 nt, synthetic construct
  misc_feature 1..2077: note = mRNA product Design d-4 comprising derived and/or modified sequence from HRSV(Memphis-37)__AIY60640.1__F0_DSCav1 (opt1)
  source 1..2077: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12619 - RNA, 2077 nt, synthetic construct
  misc_feature 1..2077: note = mRNA product Design d-4 comprising derived and/or modified sequence from HRSV(Memphis-37)__AIY60640.1__F0_DSCav1 (opt2)
  source 1..2077: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12620 - RNA, 2077 nt, synthetic construct
  misc_feature 1..2077: note = mRNA product Design d-4 comprising derived and/or modified sequence from HRSV(Memphis-37)__AIY60640.1__F0_DSCav1 (opt3)
  source 1..2077: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12621 - RNA, 2077 nt, synthetic construct
  misc_feature 1..2077: note = mRNA product Design d-4 comprising derived and/or modified sequence from HRSV(Memphis-37)__AIY60640.1__F0_DSCav1 (opt4)
  source 1..2077: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12622 - RNA, 2077 nt, synthetic construct
  misc_feature 1..2077: note = mRNA product Design d-4 comprising derived and/or modified sequence from HRSV(Memphis-37)__AIY60640.1__F0_DSCav1 (opt5)
  source 1..2077: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12623 - RNA, 2077 nt, synthetic construct
  misc_feature 1..2077: note = mRNA product Design d-4 comprising derived and/or modified sequence from HRSV(Memphis-37)__AIY60640.1__F0_DSCav1 (opt6)
  source 1..2077: mol_type = other RNA
gggagagtcccgcagtcggcgtccagcggctctgcttgttcgtgtgtgtgtcgttgcaggccttattcaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12624 - RNA, 2077 nt, synthetic construct
  misc_feature 1..2077: note = mRNA product Design d-4 comprising derived and/or modified sequence from HRSV(Memphis-37)__AIY60640.1__F0_DSCav1 (opt11)
  source 1..2077: mol_type = other RNA
gggagagtcccgcagtcggcgtccagcggctctgcttgttcgtgtgtgtgtcgttgcaggccttattcaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12625 - RNA, 2174 nt, synthetic construct
  misc_feature 1..2174: note = mRNA product Design d-5 comprising derived and/or modified sequence from HRSV(Memphis-37)__AIY60640.1__F0_DSCav1 (opt1)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12626 - RNA, 2174 nt, synthetic construct
  misc_feature 1..2174: note = mRNA product Design d-5 comprising derived and/or modified sequence from HRSV(Memphis-37)__AIY60640.1__F0_DSCav1 (opt1)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12627 - RNA, 2174 nt, synthetic construct
  misc_feature 1..2174: note = mRNA product Design d-5 comprising derived and/or modified sequence from HRSV(Memphis-37)__AIY60640.1__F0_DSCav1 (opt2)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12628 - RNA, 2174 nt, synthetic construct
  misc_feature 1..2174: note = mRNA product Design d-5 comprising derived and/or modified sequence from HRSV(Memphis-37)__AIY60640.1__F0_DSCav1 (opt3)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12629 - RNA, 2174 nt, synthetic construct
  misc_feature 1..2174: note = mRNA product Design d-5 comprising derived and/or modified sequence from HRSV(Memphis-37)__AIY60640.1__F0_DSCav1 (opt4)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12630 - RNA, 2174 nt, synthetic construct
  misc_feature 1..2174: note = mRNA product Design d-5 comprising derived and/or modified sequence from HRSV(Memphis-37)__AIY60640.1__F0_DSCav1 (opt5)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12631 - RNA, 2174 nt, synthetic construct
  misc_feature 1..2174: note = mRNA product Design d-5 comprising derived and/or modified sequence from HRSV(Memphis-37)__AIY60640.1__F0_DSCav1 (opt6)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12632 - RNA, 2174 nt, synthetic construct
  misc_feature 1..2174: note = mRNA product Design d-5 comprising derived and/or modified sequence from HRSV(Memphis-37)__AIY60640.1__F0_DSCav1 (opt11)
  source 1..2174: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12633 - RNA, 2054 nt, synthetic construct
  misc_feature 1..2054: note = mRNA product Design e-1 comprising derived and/or modified sequence from HRSV(Memphis-37)__AIY60640.1__F0_DSCav1 (opt1)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12634 - RNA, 2054 nt, synthetic construct
  misc_feature 1..2054: note = mRNA product Design e-1 comprising derived and/or modified sequence from HRSV(Memphis-37)__AIY60640.1__F0_DSCav1 (opt1)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12635 - RNA, 2054 nt, synthetic construct
  misc_feature 1..2054: note = mRNA product Design e-1 comprising derived and/or modified sequence from HRSV(Memphis-37)__AIY60640.1__F0_DSCav1 (opt2)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12636 - RNA, 2054 nt, synthetic construct
  misc_feature 1..2054: note = mRNA product Design e-1 comprising derived and/or modified sequence from HRSV(Memphis-37)__AIY60640.1__F0_DSCav1 (opt3)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12637 - RNA, 2054 nt, synthetic construct
  misc_feature 1..2054: note = mRNA product Design e-1 comprising derived and/or modified sequence from HRSV(Memphis-37)__AIY60640.1__F0_DSCav1 (opt4)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12638 - RNA, 2054 nt, synthetic construct
  misc_feature 1..2054: note = mRNA product Design e-1 comprising derived and/or modified sequence from HRSV(Memphis-37)__AIY60640.1__F0_DSCav1 (opt5)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12639 - RNA, 2054 nt, synthetic construct
  misc_feature 1..2054: note = mRNA product Design e-1 comprising derived and/or modified sequence from HRSV(Memphis-37)__AIY60640.1__F0_DSCav1 (opt6)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12640 - RNA, 2054 nt, synthetic construct
  misc_feature 1..2054: note = mRNA product Design e-1 comprising derived and/or modified sequence from HRSV(Memphis-37)__AIY60640.1__F0_DSCav1 (opt11)
  source 1..2054: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12641 - RNA, 2036 nt, synthetic construct
  misc_feature 1..2036: note = mRNA product Design e-2 comprising derived and/or modified sequence from HRSV(Memphis-37)__AIY60640.1__F0_DSCav1 (opt1)
  source 1..2036: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12642 - RNA, 2036 nt, synthetic construct
  misc_feature 1..2036: note = mRNA product Design e-2 comprising derived and/or modified sequence from HRSV(Memphis-37)__AIY60640.1__F0_DSCav1 (opt1)
  source 1..2036: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12643 - RNA, 2036 nt, synthetic construct
  misc_feature 1..2036: note = mRNA product Design e-2 comprising derived and/or modified sequence from HRSV(Memphis-37)__AIY60640.1__F0_DSCav1 (opt2)
  source 1..2036: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12644 - RNA, 2036 nt, synthetic construct
  misc_feature 1..2036: note = mRNA product Design e-2 comprising derived and/or modified sequence from HRSV(Memphis-37)__AIY60640.1__F0_DSCav1 (opt3)
  source 1..2036: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12645 - RNA, 2036 nt, synthetic construct
  misc_feature 1..2036: note = mRNA product Design e-2 comprising derived and/or modified sequence from HRSV(Memphis-37)__AIY60640.1__F0_DSCav1 (opt4)
  source 1..2036: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12646 - RNA, 2036 nt, synthetic construct
  misc_feature 1..2036: note = mRNA product Design e-2 comprising derived and/or modified sequence from HRSV(Memphis-37)__AIY60640.1__F0_DSCav1 (opt5)
  source 1..2036: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12647 - RNA, 2036 nt, synthetic construct
  misc_feature 1..2036: note = mRNA product Design e-2 comprising derived and/or modified sequence from HRSV(Memphis-37)__AIY60640.1__F0_DSCav1 (opt6)
  source 1..2036: mol_type = other RNA
gggagacccgtgacccggaagttgtacggctacgcgactttccctcccacaaaccctcgcgcccttcctttcctacttgggcccggcagaaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12648 - RNA, 2036 nt, synthetic construct
  misc_feature 1..2036: note = mRNA product Design e-2 comprising derived and/or modified sequence from HRSV(Memphis-37)__AIY60640.1__F0_DSCav1 (opt11)
  source 1..2036: mol_type = other RNA
gggagacccgtgacccggaagttgtacggctacgcgactttccctcccacaaaccctcgcgcccttcctttcctacttgggcccggcagaaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12649 - RNA, 2006 nt, synthetic construct
  misc_feature 1..2006: note = mRNA product Design e-3 comprising derived and/or modified sequence from HRSV(Memphis-37)__AIY60640.1__F0_DSCav1 (opt1)
  source 1..2006: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12650 - RNA, 2006 nt, synthetic construct
  misc_feature 1..2006: note = mRNA product Design e-3 comprising derived and/or modified sequence from HRSV(Memphis-37)__AIY60640.1__F0_DSCav1 (opt1)
  source 1..2006: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12651 - RNA, 2006 nt, synthetic construct
  misc_feature 1..2006: note = mRNA product Design e-3 comprising derived and/or modified sequence from HRSV(Memphis-37)__AIY60640.1__F0_DSCav1 (opt2)
  source 1..2006: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12652 - RNA, 2006 nt, synthetic construct
  misc_feature 1..2006: note = mRNA product Design e-3 comprising derived and/or modified sequence from HRSV(Memphis-37)__AIY60640.1__F0_DSCav1 (opt3)
  source 1..2006: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12653 - RNA, 2006 nt, synthetic construct
  misc_feature 1..2006: note = mRNA product Design e-3 comprising derived and/or modified sequence from HRSV(Memphis-37)__AIY60640.1__F0_DSCav1 (opt4)
  source 1..2006: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12654 - RNA, 2006 nt, synthetic construct
  misc_feature 1..2006: note = mRNA product Design e-3 comprising derived and/or modified sequence from HRSV(Memphis-37)__AIY60640.1__F0_DSCav1 (opt5)
  source 1..2006: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12655 - RNA, 2006 nt, synthetic construct
  misc_feature 1..2006: note = mRNA product Design e-3 comprising derived and/or modified sequence from HRSV(Memphis-37)__AIY60640.1__F0_DSCav1 (opt6)
  source 1..2006: mol_type = other RNA
gggagactttcccattctgtagcagaatttggtgttgcctgtggtcttggtcccgcggagaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12656 - RNA, 2006 nt, synthetic construct
  misc_feature 1..2006: note = mRNA product Design e-3 comprising derived and/or modified sequence from HRSV(Memphis-37)__AIY60640.1__F0_DSCav1 (opt11)
  source 1..2006: mol_type = other RNA
gggagactttcccattctgtagcagaatttggtgttgcctgtggtcttggtcccgcggagaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12657 - RNA, 2060 nt, synthetic construct
  misc_feature 1..2060: note = mRNA product Design e-4 comprising derived and/or modified sequence from HRSV(Memphis-37)__AIY60640.1__F0_DSCav1 (opt1)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12658 - RNA, 2060 nt, synthetic construct
  misc_feature 1..2060: note = mRNA product Design e-4 comprising derived and/or modified sequence from HRSV(Memphis-37)__AIY60640.1__F0_DSCav1 (opt1)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12659 - RNA, 2060 nt, synthetic construct
  misc_feature 1..2060: note = mRNA product Design e-4 comprising derived and/or modified sequence from HRSV(Memphis-37)__AIY60640.1__F0_DSCav1 (opt2)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12660 - RNA, 2060 nt, synthetic construct
  misc_feature 1..2060: note = mRNA product Design e-4 comprising derived and/or modified sequence from HRSV(Memphis-37)__AIY60640.1__F0_DSCav1 (opt3)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12661 - RNA, 2060 nt, synthetic construct
  misc_feature 1..2060: note = mRNA product Design e-4 comprising derived and/or modified sequence from HRSV(Memphis-37)__AIY60640.1__F0_DSCav1 (opt4)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12662 - RNA, 2060 nt, synthetic construct
  misc_feature 1..2060: note = mRNA product Design e-4 comprising derived and/or modified sequence from HRSV(Memphis-37)__AIY60640.1__F0_DSCav1 (opt5)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12663 - RNA, 2060 nt, synthetic construct
  misc_feature 1..2060: note = mRNA product Design e-4 comprising derived and/or modified sequence from HRSV(Memphis-37)__AIY60640.1__F0_DSCav1 (opt6)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12664 - RNA, 2060 nt, synthetic construct
  misc_feature 1..2060: note = mRNA product Design e-4 comprising derived and/or modified sequence from HRSV(Memphis-37)__AIY60640.1__F0_DSCav1 (opt11)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12665 - RNA, 2027 nt, synthetic construct
  misc_feature 1..2027: note = mRNA product Design e-5 comprising derived and/or modified sequence from HRSV(Memphis-37)__AIY60640.1__F0_DSCav1 (opt1)
  source 1..2027: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12666 - RNA, 2027 nt, synthetic construct
  misc_feature 1..2027: note = mRNA product Design e-5 comprising derived and/or modified sequence from HRSV(Memphis-37)__AIY60640.1__F0_DSCav1 (opt1)
  source 1..2027: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12667 - RNA, 2027 nt, synthetic construct
  misc_feature 1..2027: note = mRNA product Design e-5 comprising derived and/or modified sequence from HRSV(Memphis-37)__AIY60640.1__F0_DSCav1 (opt2)
  source 1..2027: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12668 - RNA, 2027 nt, synthetic construct
  misc_feature 1..2027: note = mRNA product Design e-5 comprising derived and/or modified sequence from HRSV(Memphis-37)__AIY60640.1__F0_DSCav1 (opt3)
  source 1..2027: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12669 - RNA, 2027 nt, synthetic construct
  misc_feature 1..2027: note = mRNA product Design e-5 comprising derived and/or modified sequence from HRSV(Memphis-37)__AIY60640.1__F0_DSCav1 (opt4)
  source 1..2027: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12670 - RNA, 2027 nt, synthetic construct
  misc_feature 1..2027: note = mRNA product Design e-5 comprising derived and/or modified sequence from HRSV(Memphis-37)__AIY60640.1__F0_DSCav1 (opt5)
  source 1..2027: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12671 - RNA, 2027 nt, synthetic construct
  misc_feature 1..2027: note = mRNA product Design e-5 comprising derived and/or modified sequence from HRSV(Memphis-37)__AIY60640.1__F0_DSCav1 (opt6)
  source 1..2027: mol_type = other RNA
gggagagcggctcggccattttgtcccagtcagtccggaggctgcggctgcagaagtaccgcctgcggagtaactgcaaagaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12672 - RNA, 2027 nt, synthetic construct
  misc_feature 1..2027: note = mRNA product Design e-5 comprising derived and/or modified sequence from HRSV(Memphis-37)__AIY60640.1__F0_DSCav1 (opt11)
  source 1..2027: mol_type = other RNA
gggagagcggctcggccattttgtcccagtcagtccggaggctgcggctgcagaagtaccgcctgcggagtaactgcaaagaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12673 - RNA, 2094 nt, synthetic construct
  misc_feature 1..2094: note = mRNA product Design e-6 comprising derived and/or modified sequence from HRSV(Memphis-37)__AIY60640.1__F0_DSCav1 (opt1)
  source 1..2094: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12674 - RNA, 2094 nt, synthetic construct
  misc_feature 1..2094: note = mRNA product Design e-6 comprising derived and/or modified sequence from HRSV(Memphis-37)__AIY60640.1__F0_DSCav1 (opt1)
  source 1..2094: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12675 - RNA, 2094 nt, synthetic construct
  misc_feature 1..2094: note = mRNA product Design e-6 comprising derived and/or modified sequence from HRSV(Memphis-37)__AIY60640.1__F0_DSCav1 (opt2)
  source 1..2094: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12676 - RNA, 2094 nt, synthetic construct
  misc_feature 1..2094: note = mRNA product Design e-6 comprising derived and/or modified sequence from HRSV(Memphis-37)__AIY60640.1__F0_DSCav1 (opt3)
  source 1..2094: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12677 - RNA, 2094 nt, synthetic construct
  misc_feature 1..2094: note = mRNA product Design e-6 comprising derived and/or modified sequence from HRSV(Memphis-37)__AIY60640.1__F0_DSCav1 (opt4)
  source 1..2094: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12678 - RNA, 2094 nt, synthetic construct
  misc_feature 1..2094: note = mRNA product Design e-6 comprising derived and/or modified sequence from HRSV(Memphis-37)__AIY60640.1__F0_DSCav1 (opt5)
  source 1..2094: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12679 - RNA, 2094 nt, synthetic construct
  misc_feature 1..2094: note = mRNA product Design e-6 comprising derived and/or modified sequence from HRSV(Memphis-37)__AIY60640.1__F0_DSCav1 (opt6)
  source 1..2094: mol_type = other RNA
gggagagcggctcggccattttgtcccagtcagtccggaggctgcggctgcagaagtaccgcctgcggagtaactgcaaagaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12680 - RNA, 2094 nt, synthetic construct
  misc_feature 1..2094: note = mRNA product Design e-6 comprising derived and/or modified sequence from HRSV(Memphis-37)__AIY60640.1__F0_DSCav1 (opt11)
  source 1..2094: mol_type = other RNA
gggagagcggctcggccattttgtcccagtcagtccggaggctgcggctgcagaagtaccgcctgcggagtaactgcaaagaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12681 - RNA, 2310 nt, synthetic construct
  misc_feature 1..2310: note = mRNA product Design f-1 comprising derived and/or modified sequence from HRSV(Memphis-37)__AIY60640.1__F0_DSCav1 (opt1)
  source 1..2310: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12682 - RNA, 2310 nt, synthetic construct
  misc_feature 1..2310: note = mRNA product Design f-1 comprising derived and/or modified sequence from HRSV(Memphis-37)__AIY60640.1__F0_DSCav1 (opt1)
  source 1..2310: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12683 - RNA, 2310 nt, synthetic construct
  misc_feature 1..2310: note = mRNA product Design f-1 comprising derived and/or modified sequence from HRSV(Memphis-37)__AIY60640.1__F0_DSCav1 (opt2)
  source 1..2310: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12684 - RNA, 2310 nt, synthetic construct
  misc_feature 1..2310: note = mRNA product Design f-1 comprising derived and/or modified sequence from HRSV(Memphis-37)__AIY60640.1__F0_DSCav1 (opt3)
  source 1..2310: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12685 - RNA, 2310 nt, synthetic construct
  misc_feature 1..2310: note = mRNA product Design f-1 comprising derived and/or modified sequence from HRSV(Memphis-37)__AIY60640.1__F0_DSCav1 (opt4)
  source 1..2310: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12686 - RNA, 2310 nt, synthetic construct
  misc_feature 1..2310: note = mRNA product Design f-1 comprising derived and/or modified sequence from HRSV(Memphis-37)__AIY60640.1__F0_DSCav1 (opt5)
  source 1..2310: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12687 - RNA, 2310 nt, synthetic construct
  misc_feature 1..2310: note = mRNA product Design f-1 comprising derived and/or modified sequence from HRSV(Memphis-37)__AIY60640.1__F0_DSCav1 (opt6)
  source 1..2310: mol_type = other RNA
gggagagcggctcggccattttgtcccagtcagtccggaggctgcggctgcagaagtaccgcctgcggagtaactgcaaagaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12688 - RNA, 2310 nt, synthetic construct
  misc_feature 1..2310: note = mRNA product Design f-1 comprising derived and/or modified sequence from HRSV(Memphis-37)__AIY60640.1__F0_DSCav1 (opt11)
  source 1..2310: mol_type = other RNA
gggagagcggctcggccattttgtcccagtcagtccggaggctgcggctgcagaagtaccgcctgcggagtaactgcaaagaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12689 - RNA, 2090 nt, synthetic construct
  misc_feature 1..2090: note = mRNA product Design f-2 comprising derived and/or modified sequence from HRSV(Memphis-37)__AIY60640.1__F0_DSCav1 (opt1)
  source 1..2090: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12690 - RNA, 2090 nt, synthetic construct
  misc_feature 1..2090: note = mRNA product Design f-2 comprising derived and/or modified sequence from HRSV(Memphis-37)__AIY60640.1__F0_DSCav1 (opt1)
  source 1..2090: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12691 - RNA, 2090 nt, synthetic construct
  misc_feature 1..2090: note = mRNA product Design f-2 comprising derived and/or modified sequence from HRSV(Memphis-37)__AIY60640.1__F0_DSCav1 (opt2)
  source 1..2090: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12692 - RNA, 2090 nt, synthetic construct
  misc_feature 1..2090: note = mRNA product Design f-2 comprising derived and/or modified sequence from HRSV(Memphis-37)__AIY60640.1__F0_DSCav1 (opt3)
  source 1..2090: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12693 - RNA, 2090 nt, synthetic construct
  misc_feature 1..2090: note = mRNA product Design f-2 comprising derived and/or modified sequence from HRSV(Memphis-37)__AIY60640.1__F0_DSCav1 (opt4)
  source 1..2090: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12694 - RNA, 2090 nt, synthetic construct
  misc_feature 1..2090: note = mRNA product Design f-2 comprising derived and/or modified sequence from HRSV(Memphis-37)__AIY60640.1__F0_DSCav1 (opt5)
  source 1..2090: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12695 - RNA, 2090 nt, synthetic construct
  misc_feature 1..2090: note = mRNA product Design f-2 comprising derived and/or modified sequence from HRSV(Memphis-37)__AIY60640.1__F0_DSCav1 (opt6)
  source 1..2090: mol_type = other RNA
gggagagcggctcggccattttgtcccagtcagtccggaggctgcggctgcagaagtaccgcctgcggagtaactgcaaagaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12696 - RNA, 2090 nt, synthetic construct
  misc_feature 1..2090: note = mRNA product Design f-2 comprising derived and/or modified sequence from HRSV(Memphis-37)__AIY60640.1__F0_DSCav1 (opt11)
  source 1..2090: mol_type = other RNA
gggagagcggctcggccattttgtcccagtcagtccggaggctgcggctgcagaagtaccgcctgcggagtaactgcaaagaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12697 - RNA, 2081 nt, synthetic construct
  misc_feature 1..2081: note = mRNA product Design f-3 comprising derived and/or modified sequence from HRSV(Memphis-37)__AIY60640.1__F0_DSCav1 (opt1)
  source 1..2081: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12698 - RNA, 2081 nt, synthetic construct
  misc_feature 1..2081: note = mRNA product Design f-3 comprising derived and/or modified sequence from HRSV(Memphis-37)__AIY60640.1__F0_DSCav1 (opt1)
  source 1..2081: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12699 - RNA, 2081 nt, synthetic construct
  misc_feature 1..2081: note = mRNA product Design f-3 comprising derived and/or modified sequence from HRSV(Memphis-37)__AIY60640.1__F0_DSCav1 (opt2)
  source 1..2081: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12700 - RNA, 2081 nt, synthetic construct
  misc_feature 1..2081: note = mRNA product Design f-3 comprising derived and/or modified sequence from HRSV(Memphis-37)__AIY60640.1__F0_DSCav1 (opt3)
  source 1..2081: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12701 - RNA, 2081 nt, synthetic construct
  misc_feature 1..2081: note = mRNA product Design f-3 comprising derived and/or modified sequence from HRSV(Memphis-37)__AIY60640.1__F0_DSCav1 (opt4)
  source 1..2081: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12702 - RNA, 2081 nt, synthetic construct
  misc_feature 1..2081: note = mRNA product Design f-3 comprising derived and/or modified sequence from HRSV(Memphis-37)__AIY60640.1__F0_DSCav1 (opt5)
  source 1..2081: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12703 - RNA, 2081 nt, synthetic construct
  misc_feature 1..2081: note = mRNA product Design f-3 comprising derived and/or modified sequence from HRSV(Memphis-37)__AIY60640.1__F0_DSCav1 (opt6)
  source 1..2081: mol_type = other RNA
gggagagtcccgcagtcggcgtccagcggctctgcttgttcgtgtgtgtgtcgttgcaggccttattcaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12704 - RNA, 2081 nt, synthetic construct
  misc_feature 1..2081: note = mRNA product Design f-3 comprising derived and/or modified sequence from HRSV(Memphis-37)__AIY60640.1__F0_DSCav1 (opt11)
  source 1..2081: mol_type = other RNA
gggagagtcccgcagtcggcgtccagcggctctgcttgttcgtgtgtgtgtcgttgcaggccttattcaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12705 - RNA, 2297 nt, synthetic construct
  misc_feature 1..2297: note = mRNA product Design f-4 comprising derived and/or modified sequence from HRSV(Memphis-37)__AIY60640.1__F0_DSCav1 (opt1)
  source 1..2297: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12706 - RNA, 2297 nt, synthetic construct
  misc_feature 1..2297: note = mRNA product Design f-4 comprising derived and/or modified sequence from HRSV(Memphis-37)__AIY60640.1__F0_DSCav1 (opt1)
  source 1..2297: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12707 - RNA, 2297 nt, synthetic construct
  misc_feature 1..2297: note = mRNA product Design f-4 comprising derived and/or modified sequence from HRSV(Memphis-37)__AIY60640.1__F0_DSCav1 (opt2)
  source 1..2297: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12708 - RNA, 2297 nt, synthetic construct
  misc_feature 1..2297: note = mRNA product Design f-4 comprising derived and/or modified sequence from HRSV(Memphis-37)__AIY60640.1__F0_DSCav1 (opt3)
  source 1..2297: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12709 - RNA, 2297 nt, synthetic construct
  misc_feature 1..2297: note = mRNA product Design f-4 comprising derived and/or modified sequence from HRSV(Memphis-37)__AIY60640.1__F0_DSCav1 (opt4)
  source 1..2297: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12710 - RNA, 2297 nt, synthetic construct
  misc_feature 1..2297: note = mRNA product Design f-4 comprising derived and/or modified sequence from HRSV(Memphis-37)__AIY60640.1__F0_DSCav1 (opt5)
  source 1..2297: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12711 - RNA, 2297 nt, synthetic construct
  misc_feature 1..2297: note = mRNA product Design f-4 comprising derived and/or modified sequence from HRSV(Memphis-37)__AIY60640.1__F0_DSCav1 (opt6)
  source 1..2297: mol_type = other RNA
gggagagtcccgcagtcggcgtccagcggctctgcttgttcgtgtgtgtgtcgttgcaggccttattcaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12712 - RNA, 2297 nt, synthetic construct
  misc_feature 1..2297: note = mRNA product Design f-4 comprising derived and/or modified sequence from HRSV(Memphis-37)__AIY60640.1__F0_DSCav1 (opt11)
  source 1..2297: mol_type = other RNA
gggagagtcccgcagtcggcgtccagcggctctgcttgttcgtgtgtgtgtcgttgcaggccttattcaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12713 - RNA, 2073 nt, synthetic construct
  misc_feature 1..2073: note = mRNA product Design f-5 comprising derived and/or modified sequence from HRSV(Memphis-37)__AIY60640.1__F0_DSCav1 (opt1)
  source 1..2073: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12714 - RNA, 2073 nt, synthetic construct
  misc_feature 1..2073: note = mRNA product Design f-5 comprising derived and/or modified sequence from HRSV(Memphis-37)__AIY60640.1__F0_DSCav1 (opt1)
  source 1..2073: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12715 - RNA, 2073 nt, synthetic construct
  misc_feature 1..2073: note = mRNA product Design f-5 comprising derived and/or modified sequence from HRSV(Memphis-37)__AIY60640.1__F0_DSCav1 (opt2)
  source 1..2073: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12716 - RNA, 2073 nt, synthetic construct
  misc_feature 1..2073: note = mRNA product Design f-5 comprising derived and/or modified sequence from HRSV(Memphis-37)__AIY60640.1__F0_DSCav1 (opt3)
  source 1..2073: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12717 - RNA, 2073 nt, synthetic construct
  misc_feature 1..2073: note = mRNA product Design f-5 comprising derived and/or modified sequence from HRSV(Memphis-37)__AIY60640.1__F0_DSCav1 (opt4)
  source 1..2073: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12718 - RNA, 2073 nt, synthetic construct
  misc_feature 1..2073: note = mRNA product Design f-5 comprising derived and/or modified sequence from HRSV(Memphis-37)__AIY60640.1__F0_DSCav1 (opt5)
  source 1..2073: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12719 - RNA, 2073 nt, synthetic construct
  misc_feature 1..2073: note = mRNA product Design f-5 comprising derived and/or modified sequence from HRSV(Memphis-37)__AIY60640.1__F0_DSCav1 (opt6)
  source 1..2073: mol_type = other RNA
gggagactttcccattctgtagcagaatttggtgttgcctgtggtcttggtcccgcggagaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12720 - RNA, 2073 nt, synthetic construct
  misc_feature 1..2073: note = mRNA product Design f-5 comprising derived and/or modified sequence from HRSV(Memphis-37)__AIY60640.1__F0_DSCav1 (opt11)
  source 1..2073: mol_type = other RNA
gggagactttcccattctgtagcagaatttggtgttgcctgtggtcttggtcccgcggagaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12721 - RNA, 2069 nt, synthetic construct
  misc_feature 1..2069: note = mRNA product Design g-1 comprising derived and/or modified sequence from HRSV(Memphis-37)__AIY60640.1__F0_DSCav1 (opt1)
  source 1..2069: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12722 - RNA, 2069 nt, synthetic construct
  misc_feature 1..2069: note = mRNA product Design g-1 comprising derived and/or modified sequence from HRSV(Memphis-37)__AIY60640.1__F0_DSCav1 (opt1)
  source 1..2069: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12723 - RNA, 2069 nt, synthetic construct
  misc_feature 1..2069: note = mRNA product Design g-1 comprising derived and/or modified sequence from HRSV(Memphis-37)__AIY60640.1__F0_DSCav1 (opt2)
  source 1..2069: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12724 - RNA, 2069 nt, synthetic construct
  misc_feature 1..2069: note = mRNA product Design g-1 comprising derived and/or modified sequence from HRSV(Memphis-37)__AIY60640.1__F0_DSCav1 (opt3)
  source 1..2069: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12725 - RNA, 2069 nt, synthetic construct
  misc_feature 1..2069: note = mRNA product Design g-1 comprising derived and/or modified sequence from HRSV(Memphis-37)__AIY60640.1__F0_DSCav1 (opt4)
  source 1..2069: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12726 - RNA, 2069 nt, synthetic construct
  misc_feature 1..2069: note = mRNA product Design g-1 comprising derived and/or modified sequence from HRSV(Memphis-37)__AIY60640.1__F0_DSCav1 (opt5)
  source 1..2069: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12727 - RNA, 2069 nt, synthetic construct
  misc_feature 1..2069: note = mRNA product Design g-1 comprising derived and/or modified sequence from HRSV(Memphis-37)__AIY60640.1__F0_DSCav1 (opt6)
  source 1..2069: mol_type = other RNA
gggagactttcccattctgtagcagaatttggtgttgcctgtggtcttggtcccgcggagaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12728 - RNA, 2069 nt, synthetic construct
  misc_feature 1..2069: note = mRNA product Design g-1 comprising derived and/or modified sequence from HRSV(Memphis-37)__AIY60640.1__F0_DSCav1 (opt11)
  source 1..2069: mol_type = other RNA
gggagactttcccattctgtagcagaatttggtgttgcctgtggtcttggtcccgcggagaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12729 - RNA, 2084 nt, synthetic construct
  misc_feature 1..2084: note = mRNA product Design g-2 comprising derived and/or modified sequence from HRSV(Memphis-37)__AIY60640.1__F0_DSCav1 (opt1)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12730 - RNA, 2084 nt, synthetic construct
  misc_feature 1..2084: note = mRNA product Design g-2 comprising derived and/or modified sequence from HRSV(Memphis-37)__AIY60640.1__F0_DSCav1 (opt1)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12731 - RNA, 2084 nt, synthetic construct
  misc_feature 1..2084: note = mRNA product Design g-2 comprising derived and/or modified sequence from HRSV(Memphis-37)__AIY60640.1__F0_DSCav1 (opt2)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12732 - RNA, 2084 nt, synthetic construct
  misc_feature 1..2084: note = mRNA product Design g-2 comprising derived and/or modified sequence from HRSV(Memphis-37)__AIY60640.1__F0_DSCav1 (opt3)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12733 - RNA, 2084 nt, synthetic construct
  misc_feature 1..2084: note = mRNA product Design g-2 comprising derived and/or modified sequence from HRSV(Memphis-37)__AIY60640.1__F0_DSCav1 (opt4)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12734 - RNA, 2084 nt, synthetic construct
  misc_feature 1..2084: note = mRNA product Design g-2 comprising derived and/or modified sequence from HRSV(Memphis-37)__AIY60640.1__F0_DSCav1 (opt5)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12735 - RNA, 2084 nt, synthetic construct
  misc_feature 1..2084: note = mRNA product Design g-2 comprising derived and/or modified sequence from HRSV(Memphis-37)__AIY60640.1__F0_DSCav1 (opt6)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12736 - RNA, 2084 nt, synthetic construct
  misc_feature 1..2084: note = mRNA product Design g-2 comprising derived and/or modified sequence from HRSV(Memphis-37)__AIY60640.1__F0_DSCav1 (opt11)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12737 - RNA, 2316 nt, synthetic construct
  misc_feature 1..2316: note = mRNA product Design g-3 comprising derived and/or modified sequence from HRSV(Memphis-37)__AIY60640.1__F0_DSCav1 (opt1)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12738 - RNA, 2316 nt, synthetic construct
  misc_feature 1..2316: note = mRNA product Design g-3 comprising derived and/or modified sequence from HRSV(Memphis-37)__AIY60640.1__F0_DSCav1 (opt1)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12739 - RNA, 2316 nt, synthetic construct
  misc_feature 1..2316: note = mRNA product Design g-3 comprising derived and/or modified sequence from HRSV(Memphis-37)__AIY60640.1__F0_DSCav1 (opt2)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12740 - RNA, 2316 nt, synthetic construct
  misc_feature 1..2316: note = mRNA product Design g-3 comprising derived and/or modified sequence from HRSV(Memphis-37)__AIY60640.1__F0_DSCav1 (opt3)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12741 - RNA, 2316 nt, synthetic construct
  misc_feature 1..2316: note = mRNA product Design g-3 comprising derived and/or modified sequence from HRSV(Memphis-37)__AIY60640.1__F0_DSCav1 (opt4)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12742 - RNA, 2316 nt, synthetic construct
  misc_feature 1..2316: note = mRNA product Design g-3 comprising derived and/or modified sequence from HRSV(Memphis-37)__AIY60640.1__F0_DSCav1 (opt5)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12743 - RNA, 2316 nt, synthetic construct
  misc_feature 1..2316: note = mRNA product Design g-3 comprising derived and/or modified sequence from HRSV(Memphis-37)__AIY60640.1__F0_DSCav1 (opt6)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12744 - RNA, 2316 nt, synthetic construct
  misc_feature 1..2316: note = mRNA product Design g-3 comprising derived and/or modified sequence from HRSV(Memphis-37)__AIY60640.1__F0_DSCav1 (opt11)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12745 - RNA, 2111 nt, synthetic construct
  misc_feature 1..2111: note = mRNA product Design g-4 comprising derived and/or modified sequence from HRSV(Memphis-37)__AIY60640.1__F0_DSCav1 (opt1)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12746 - RNA, 2111 nt, synthetic construct
  misc_feature 1..2111: note = mRNA product Design g-4 comprising derived and/or modified sequence from HRSV(Memphis-37)__AIY60640.1__F0_DSCav1 (opt1)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12747 - RNA, 2111 nt, synthetic construct
  misc_feature 1..2111: note = mRNA product Design g-4 comprising derived and/or modified sequence from HRSV(Memphis-37)__AIY60640.1__F0_DSCav1 (opt2)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12748 - RNA, 2111 nt, synthetic construct
  misc_feature 1..2111: note = mRNA product Design g-4 comprising derived and/or modified sequence from HRSV(Memphis-37)__AIY60640.1__F0_DSCav1 (opt3)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12749 - RNA, 2111 nt, synthetic construct
  misc_feature 1..2111: note = mRNA product Design g-4 comprising derived and/or modified sequence from HRSV(Memphis-37)__AIY60640.1__F0_DSCav1 (opt4)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12750 - RNA, 2111 nt, synthetic construct
  misc_feature 1..2111: note = mRNA product Design g-4 comprising derived and/or modified sequence from HRSV(Memphis-37)__AIY60640.1__F0_DSCav1 (opt5)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12751 - RNA, 2111 nt, synthetic construct
  misc_feature 1..2111: note = mRNA product Design g-4 comprising derived and/or modified sequence from HRSV(Memphis-37)__AIY60640.1__F0_DSCav1 (opt6)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12752 - RNA, 2111 nt, synthetic construct
  misc_feature 1..2111: note = mRNA product Design g-4 comprising derived and/or modified sequence from HRSV(Memphis-37)__AIY60640.1__F0_DSCav1 (opt11)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12753 - RNA, 2087 nt, synthetic construct
  misc_feature 1..2087: note = mRNA product Design g-5 comprising derived and/or modified sequence from HRSV(Memphis-37)__AIY60640.1__F0_DSCav1 (opt1)
  source 1..2087: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12754 - RNA, 2087 nt, synthetic construct
  misc_feature 1..2087: note = mRNA product Design g-5 comprising derived and/or modified sequence from HRSV(Memphis-37)__AIY60640.1__F0_DSCav1 (opt1)
  source 1..2087: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12755 - RNA, 2087 nt, synthetic construct
  misc_feature 1..2087: note = mRNA product Design g-5 comprising derived and/or modified sequence from HRSV(Memphis-37)__AIY60640.1__F0_DSCav1 (opt2)
  source 1..2087: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12756 - RNA, 2087 nt, synthetic construct
  misc_feature 1..2087: note = mRNA product Design g-5 comprising derived and/or modified sequence from HRSV(Memphis-37)__AIY60640.1__F0_DSCav1 (opt3)
  source 1..2087: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12757 - RNA, 2087 nt, synthetic construct
  misc_feature 1..2087: note = mRNA product Design g-5 comprising derived and/or modified sequence from HRSV(Memphis-37)__AIY60640.1__F0_DSCav1 (opt4)
  source 1..2087: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12758 - RNA, 2087 nt, synthetic construct
  misc_feature 1..2087: note = mRNA product Design g-5 comprising derived and/or modified sequence from HRSV(Memphis-37)__AIY60640.1__F0_DSCav1 (opt5)
  source 1..2087: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12759 - RNA, 2087 nt, synthetic construct
  misc_feature 1..2087: note = mRNA product Design g-5 comprising derived and/or modified sequence from HRSV(Memphis-37)__AIY60640.1__F0_DSCav1 (opt6)
  source 1..2087: mol_type = other RNA
gggagacccgtgacccggaagttgtacggctacgcgactttccctcccacaaaccctcgcgcccttcctttcctacttgggcccggcagaaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12760 - RNA, 2087 nt, synthetic construct
  misc_feature 1..2087: note = mRNA product Design g-5 comprising derived and/or modified sequence from HRSV(Memphis-37)__AIY60640.1__F0_DSCav1 (opt11)
  source 1..2087: mol_type = other RNA
gggagacccgtgacccggaagttgtacggctacgcgactttccctcccacaaaccctcgcgcccttcctttcctacttgggcccggcagaaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12761 - RNA, 2103 nt, synthetic construct
  misc_feature 1..2103: note = mRNA product Design h-1 comprising derived and/or modified sequence from HRSV(Memphis-37)__AIY60640.1__F0_DSCav1 (opt1)
  source 1..2103: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12762 - RNA, 2103 nt, synthetic construct
  misc_feature 1..2103: note = mRNA product Design h-1 comprising derived and/or modified sequence from HRSV(Memphis-37)__AIY60640.1__F0_DSCav1 (opt1)
  source 1..2103: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12763 - RNA, 2103 nt, synthetic construct
  misc_feature 1..2103: note = mRNA product Design h-1 comprising derived and/or modified sequence from HRSV(Memphis-37)__AIY60640.1__F0_DSCav1 (opt2)
  source 1..2103: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12764 - RNA, 2103 nt, synthetic construct
  misc_feature 1..2103: note = mRNA product Design h-1 comprising derived and/or modified sequence from HRSV(Memphis-37)__AIY60640.1__F0_DSCav1 (opt3)
  source 1..2103: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12765 - RNA, 2103 nt, synthetic construct
  misc_feature 1..2103: note = mRNA product Design h-1 comprising derived and/or modified sequence from HRSV(Memphis-37)__AIY60640.1__F0_DSCav1 (opt4)
  source 1..2103: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12766 - RNA, 2103 nt, synthetic construct
  misc_feature 1..2103: note = mRNA product Design h-1 comprising derived and/or modified sequence from HRSV(Memphis-37)__AIY60640.1__F0_DSCav1 (opt5)
  source 1..2103: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12767 - RNA, 2103 nt, synthetic construct
  misc_feature 1..2103: note = mRNA product Design h-1 comprising derived and/or modified sequence from HRSV(Memphis-37)__AIY60640.1__F0_DSCav1 (opt6)
  source 1..2103: mol_type = other RNA
gggagacccgtgacccggaagttgtacggctacgcgactttccctcccacaaaccctcgcgcccttcctttcctacttgggcccggcagaaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12768 - RNA, 2103 nt, synthetic construct
  misc_feature 1..2103: note = mRNA product Design h-1 comprising derived and/or modified sequence from HRSV(Memphis-37)__AIY60640.1__F0_DSCav1 (opt11)
  source 1..2103: mol_type = other RNA
gggagacccgtgacccggaagttgtacggctacgcgactttccctcccacaaaccctcgcgcccttcctttcctacttgggcccggcagaaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12769 - RNA, 2319 nt, synthetic construct
  misc_feature 1..2319: note = mRNA product Design h-2 comprising derived and/or modified sequence from HRSV(Memphis-37)__AIY60640.1__F0_DSCav1 (opt1)
  source 1..2319: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12770 - RNA, 2319 nt, synthetic construct
  misc_feature 1..2319: note = mRNA product Design h-2 comprising derived and/or modified sequence from HRSV(Memphis-37)__AIY60640.1__F0_DSCav1 (opt1)
  source 1..2319: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12771 - RNA, 2319 nt, synthetic construct
  misc_feature 1..2319: note = mRNA product Design h-2 comprising derived and/or modified sequence from HRSV(Memphis-37)__AIY60640.1__F0_DSCav1 (opt2)
  source 1..2319: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12772 - RNA, 2319 nt, synthetic construct
  misc_feature 1..2319: note = mRNA product Design h-2 comprising derived and/or modified sequence from HRSV(Memphis-37)__AIY60640.1__F0_DSCav1 (opt3)
  source 1..2319: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12773 - RNA, 2319 nt, synthetic construct
  misc_feature 1..2319: note = mRNA product Design h-2 comprising derived and/or modified sequence from HRSV(Memphis-37)__AIY60640.1__F0_DSCav1 (opt4)
  source 1..2319: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12774 - RNA, 2319 nt, synthetic construct
  misc_feature 1..2319: note = mRNA product Design h-2 comprising derived and/or modified sequence from HRSV(Memphis-37)__AIY60640.1__F0_DSCav1 (opt5)
  source 1..2319: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12775 - RNA, 2319 nt, synthetic construct
  misc_feature 1..2319: note = mRNA product Design h-2 comprising derived and/or modified sequence from HRSV(Memphis-37)__AIY60640.1__F0_DSCav1 (opt6)
  source 1..2319: mol_type = other RNA
gggagacccgtgacccggaagttgtacggctacgcgactttccctcccacaaaccctcgcgcccttcctttcctacttgggcccggcagaaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12776 - RNA, 2319 nt, synthetic construct
  misc_feature 1..2319: note = mRNA product Design h-2 comprising derived and/or modified sequence from HRSV(Memphis-37)__AIY60640.1__F0_DSCav1 (opt11)
  source 1..2319: mol_type = other RNA
gggagacccgtgacccggaagttgtacggctacgcgactttccctcccacaaaccctcgcgcccttcctttcctacttgggcccggcagaaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12777 - RNA, 2099 nt, synthetic construct
  misc_feature 1..2099: note = mRNA product Design h-3 comprising derived and/or modified sequence from HRSV(Memphis-37)__AIY60640.1__F0_DSCav1 (opt1)
  source 1..2099: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12778 - RNA, 2099 nt, synthetic construct
  misc_feature 1..2099: note = mRNA product Design h-3 comprising derived and/or modified sequence from HRSV(Memphis-37)__AIY60640.1__F0_DSCav1 (opt1)
  source 1..2099: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12779 - RNA, 2099 nt, synthetic construct
  misc_feature 1..2099: note = mRNA product Design h-3 comprising derived and/or modified sequence from HRSV(Memphis-37)__AIY60640.1__F0_DSCav1 (opt2)
  source 1..2099: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12780 - RNA, 2099 nt, synthetic construct
  misc_feature 1..2099: note = mRNA product Design h-3 comprising derived and/or modified sequence from HRSV(Memphis-37)__AIY60640.1__F0_DSCav1 (opt3)
  source 1..2099: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12781 - RNA, 2099 nt, synthetic construct
  misc_feature 1..2099: note = mRNA product Design h-3 comprising derived and/or modified sequence from HRSV(Memphis-37)__AIY60640.1__F0_DSCav1 (opt4)
  source 1..2099: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12782 - RNA, 2099 nt, synthetic construct
  misc_feature 1..2099: note = mRNA product Design h-3 comprising derived and/or modified sequence from HRSV(Memphis-37)__AIY60640.1__F0_DSCav1 (opt5)
  source 1..2099: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12783 - RNA, 2099 nt, synthetic construct
  misc_feature 1..2099: note = mRNA product Design h-3 comprising derived and/or modified sequence from HRSV(Memphis-37)__AIY60640.1__F0_DSCav1 (opt6)
  source 1..2099: mol_type = other RNA
gggagacccgtgacccggaagttgtacggctacgcgactttccctcccacaaaccctcgcgcccttcctttcctacttgggcccggcagaaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12784 - RNA, 2099 nt, synthetic construct
  misc_feature 1..2099: note = mRNA product Design h-3 comprising derived and/or modified sequence from HRSV(Memphis-37)__AIY60640.1__F0_DSCav1 (opt11)
  source 1..2099: mol_type = other RNA
gggagacccgtgacccggaagttgtacggctacgcgactttccctcccacaaaccctcgcgcccttcctttcctacttgggcccggcagaaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12785 - RNA, 2162 nt, synthetic construct
  misc_feature 1..2162: note = mRNA product Design h-4 comprising derived and/or modified sequence from HRSV(Memphis-37)__AIY60640.1__F0_DSCav1 (opt1)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12786 - RNA, 2162 nt, synthetic construct
  misc_feature 1..2162: note = mRNA product Design h-4 comprising derived and/or modified sequence from HRSV(Memphis-37)__AIY60640.1__F0_DSCav1 (opt1)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12787 - RNA, 2162 nt, synthetic construct
  misc_feature 1..2162: note = mRNA product Design h-4 comprising derived and/or modified sequence from HRSV(Memphis-37)__AIY60640.1__F0_DSCav1 (opt2)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12788 - RNA, 2162 nt, synthetic construct
  misc_feature 1..2162: note = mRNA product Design h-4 comprising derived and/or modified sequence from HRSV(Memphis-37)__AIY60640.1__F0_DSCav1 (opt3)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12789 - RNA, 2162 nt, synthetic construct
  misc_feature 1..2162: note = mRNA product Design h-4 comprising derived and/or modified sequence from HRSV(Memphis-37)__AIY60640.1__F0_DSCav1 (opt4)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12790 - RNA, 2162 nt, synthetic construct
  misc_feature 1..2162: note = mRNA product Design h-4 comprising derived and/or modified sequence from HRSV(Memphis-37)__AIY60640.1__F0_DSCav1 (opt5)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12791 - RNA, 2162 nt, synthetic construct
  misc_feature 1..2162: note = mRNA product Design h-4 comprising derived and/or modified sequence from HRSV(Memphis-37)__AIY60640.1__F0_DSCav1 (opt6)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12792 - RNA, 2162 nt, synthetic construct
  misc_feature 1..2162: note = mRNA product Design h-4 comprising derived and/or modified sequence from HRSV(Memphis-37)__AIY60640.1__F0_DSCav1 (opt11)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12793 - RNA, 2178 nt, synthetic construct
  misc_feature 1..2178: note = mRNA product Design h-5 comprising derived and/or modified sequence from HRSV(Memphis-37)__AIY60640.1__F0_DSCav1 (opt1)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12794 - RNA, 2178 nt, synthetic construct
  misc_feature 1..2178: note = mRNA product Design h-5 comprising derived and/or modified sequence from HRSV(Memphis-37)__AIY60640.1__F0_DSCav1 (opt1)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12795 - RNA, 2178 nt, synthetic construct
  misc_feature 1..2178: note = mRNA product Design h-5 comprising derived and/or modified sequence from HRSV(Memphis-37)__AIY60640.1__F0_DSCav1 (opt2)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12796 - RNA, 2178 nt, synthetic construct
  misc_feature 1..2178: note = mRNA product Design h-5 comprising derived and/or modified sequence from HRSV(Memphis-37)__AIY60640.1__F0_DSCav1 (opt3)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12797 - RNA, 2178 nt, synthetic construct
  misc_feature 1..2178: note = mRNA product Design h-5 comprising derived and/or modified sequence from HRSV(Memphis-37)__AIY60640.1__F0_DSCav1 (opt4)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12798 - RNA, 2178 nt, synthetic construct
  misc_feature 1..2178: note = mRNA product Design h-5 comprising derived and/or modified sequence from HRSV(Memphis-37)__AIY60640.1__F0_DSCav1 (opt5)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12799 - RNA, 2178 nt, synthetic construct
  misc_feature 1..2178: note = mRNA product Design h-5 comprising derived and/or modified sequence from HRSV(Memphis-37)__AIY60640.1__F0_DSCav1 (opt6)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12800 - RNA, 2178 nt, synthetic construct
  misc_feature 1..2178: note = mRNA product Design h-5 comprising derived and/or modified sequence from HRSV(Memphis-37)__AIY60640.1__F0_DSCav1 (opt11)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12801 - RNA, 2111 nt, synthetic construct
  misc_feature 1..2111: note = mRNA product Design i-1 comprising derived and/or modified sequence from HRSV(Memphis-37)__AIY60640.1__F0_DSCav1 (opt1)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12802 - RNA, 2111 nt, synthetic construct
  misc_feature 1..2111: note = mRNA product Design i-1 comprising derived and/or modified sequence from HRSV(Memphis-37)__AIY60640.1__F0_DSCav1 (opt1)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12803 - RNA, 2111 nt, synthetic construct
  misc_feature 1..2111: note = mRNA product Design i-1 comprising derived and/or modified sequence from HRSV(Memphis-37)__AIY60640.1__F0_DSCav1 (opt2)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12804 - RNA, 2111 nt, synthetic construct
  misc_feature 1..2111: note = mRNA product Design i-1 comprising derived and/or modified sequence from HRSV(Memphis-37)__AIY60640.1__F0_DSCav1 (opt3)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12805 - RNA, 2111 nt, synthetic construct
  misc_feature 1..2111: note = mRNA product Design i-1 comprising derived and/or modified sequence from HRSV(Memphis-37)__AIY60640.1__F0_DSCav1 (opt4)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12806 - RNA, 2111 nt, synthetic construct
  misc_feature 1..2111: note = mRNA product Design i-1 comprising derived and/or modified sequence from HRSV(Memphis-37)__AIY60640.1__F0_DSCav1 (opt5)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12807 - RNA, 2111 nt, synthetic construct
  misc_feature 1..2111: note = mRNA product Design i-1 comprising derived and/or modified sequence from HRSV(Memphis-37)__AIY60640.1__F0_DSCav1 (opt6)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12808 - RNA, 2111 nt, synthetic construct
  misc_feature 1..2111: note = mRNA product Design i-1 comprising derived and/or modified sequence from HRSV(Memphis-37)__AIY60640.1__F0_DSCav1 (opt11)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12809 - RNA, 2111 nt, synthetic construct
  misc_feature 1..2111: note = mRNA product Design i-2 comprising derived and/or modified sequence from HRSV(Memphis-37)__AIY60640.1__F0_DSCav1 (opt1)
  source 1..2111: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12810 - RNA, 2111 nt, synthetic construct
  misc_feature 1..2111: note = mRNA product Design i-2 comprising derived and/or modified sequence from HRSV(Memphis-37)__AIY60640.1__F0_DSCav1 (opt1)
  source 1..2111: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12811 - RNA, 2111 nt, synthetic construct
  misc_feature 1..2111: note = mRNA product Design i-2 comprising derived and/or modified sequence from HRSV(Memphis-37)__AIY60640.1__F0_DSCav1 (opt2)
  source 1..2111: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12812 - RNA, 2111 nt, synthetic construct
  misc_feature 1..2111: note = mRNA product Design i-2 comprising derived and/or modified sequence from HRSV(Memphis-37)__AIY60640.1__F0_DSCav1 (opt3)
  source 1..2111: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12813 - RNA, 2111 nt, synthetic construct
  misc_feature 1..2111: note = mRNA product Design i-2 comprising derived and/or modified sequence from HRSV(Memphis-37)__AIY60640.1__F0_DSCav1 (opt4)
  source 1..2111: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12814 - RNA, 2111 nt, synthetic construct
  misc_feature 1..2111: note = mRNA product Design i-2 comprising derived and/or modified sequence from HRSV(Memphis-37)__AIY60640.1__F0_DSCav1 (opt5)
  source 1..2111: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12815 - RNA, 2111 nt, synthetic construct
  misc_feature 1..2111: note = mRNA product Design i-2 comprising derived and/or modified sequence from HRSV(Memphis-37)__AIY60640.1__F0_DSCav1 (opt6)
  source 1..2111: mol_type = other RNA
gggagaggcgctgcctacggaggtggcagccatctccttctcggcatcaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12816 - RNA, 2111 nt, synthetic construct
  misc_feature 1..2111: note = mRNA product Design i-2 comprising derived and/or modified sequence from HRSV(Memphis-37)__AIY60640.1__F0_DSCav1 (opt11)
  source 1..2111: mol_type = other RNA
gggagaggcgctgcctacggaggtggcagccatctccttctcggcatcaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12817 - RNA, 2107 nt, synthetic construct
  misc_feature 1..2107: note = mRNA product Design i-2 comprising derived and/or modified sequence from HRSV(Memphis-37)__AIY60640.1__F0_DSCav1 (opt1)
  source 1..2107: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12818 - RNA, 2107 nt, synthetic construct
  misc_feature 1..2107: note = mRNA product Design i-2 comprising derived and/or modified sequence from HRSV(Memphis-37)__AIY60640.1__F0_DSCav1 (opt1)
  source 1..2107: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12819 - RNA, 2107 nt, synthetic construct
  misc_feature 1..2107: note = mRNA product Design i-2 comprising derived and/or modified sequence from HRSV(Memphis-37)__AIY60640.1__F0_DSCav1 (opt2)
  source 1..2107: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12820 - RNA, 2107 nt, synthetic construct
  misc_feature 1..2107: note = mRNA product Design i-2 comprising derived and/or modified sequence from HRSV(Memphis-37)__AIY60640.1__F0_DSCav1 (opt3)
  source 1..2107: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12821 - RNA, 2107 nt, synthetic construct
  misc_feature 1..2107: note = mRNA product Design i-2 comprising derived and/or modified sequence from HRSV(Memphis-37)__AIY60640.1__F0_DSCav1 (opt4)
  source 1..2107: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12822 - RNA, 2107 nt, synthetic construct
  misc_feature 1..2107: note = mRNA product Design i-2 comprising derived and/or modified sequence from HRSV(Memphis-37)__AIY60640.1__F0_DSCav1 (opt5)
  source 1..2107: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12823 - RNA, 2107 nt, synthetic construct
  misc_feature 1..2107: note = mRNA product Design i-2 comprising derived and/or modified sequence from HRSV(Memphis-37)__AIY60640.1__F0_DSCav1 (opt6)
  source 1..2107: mol_type = other RNA
ggggcgctgcctacggaggtggcagccatctccttctcggcatcaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12824 - RNA, 2107 nt, synthetic construct
  misc_feature 1..2107: note = mRNA product Design i-2 comprising derived and/or modified sequence from HRSV(Memphis-37)__AIY60640.1__F0_DSCav1 (opt11)
  source 1..2107: mol_type = other RNA
ggggcgctgcctacggaggtggcagccatctccttctcggcatcaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12825 - RNA, 1942 nt, synthetic construct
  misc_feature 1..1942: note = mRNA product Design i-3 comprising derived and/or modified sequence from HRSV(Memphis-37)__AIY60640.1__F0_DSCav1 (opt1)
  source 1..1942: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12826 - RNA, 1942 nt, synthetic construct
  misc_feature 1..1942: note = mRNA product Design i-3 comprising derived and/or modified sequence from HRSV(Memphis-37)__AIY60640.1__F0_DSCav1 (opt1)
  source 1..1942: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgcagcacccccgtcacgctgtccaaggaccagctcagcgggatcaacaacatcgcgttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12827 - RNA, 1942 nt, synthetic construct
  misc_feature 1..1942: note = mRNA product Design i-3 comprising derived and/or modified sequence from HRSV(Memphis-37)__AIY60640.1__F0_DSCav1 (opt2)
  source 1..1942: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12828 - RNA, 1942 nt, synthetic construct
  misc_feature 1..1942: note = mRNA product Design i-3 comprising derived and/or modified sequence from HRSV(Memphis-37)__AIY60640.1__F0_DSCav1 (opt3)
  source 1..1942: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggagtactcctgtaacactctctaaggaccagctgagcggcattaataacatcgccttttccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12829 - RNA, 1942 nt, synthetic construct
  misc_feature 1..1942: note = mRNA product Design i-3 comprising derived and/or modified sequence from HRSV(Memphis-37)__AIY60640.1__F0_DSCav1 (opt4)
  source 1..1942: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12830 - RNA, 1942 nt, synthetic construct
  misc_feature 1..1942: note = mRNA product Design i-3 comprising derived and/or modified sequence from HRSV(Memphis-37)__AIY60640.1__F0_DSCav1 (opt5)
  source 1..1942: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtctacaccggtcaccctttccaaggaccagctgagcgggatcaataacattgccttttctaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12831 - RNA, 1942 nt, synthetic construct
  misc_feature 1..1942: note = mRNA product Design i-3 comprising derived and/or modified sequence from HRSV(Memphis-37)__AIY60640.1__F0_DSCav1 (opt6)
  source 1..1942: mol_type = other RNA
gggagaaagcttaccatggaactcccaatcctcaaaaccaatgccataacaaccatactcgctgcagtaaccttatgtttcgcaagtagccaaaacataaccgaagaattttatcaatccacatgctccgcagtttctaaaggatatctatcagcattaagaactggatggtacacatctgtaataactatagaactaagcaatataaaagaaaacaaatgtaacggaactgacgctaaagtaaaacttataaaacaagaactagataaatacaaaaacgccgttaccgaactacaactattaatgcaatcaacaccagccgcaaataacagagcaagacgcgaattaccaagattcatgaattacacactaaacaatacaaaaaataacaatgtaacactatcaaaaaaaagaaaacgacgattcttaggcttcctactaggagtcggctcagcaatagcttccggaatagccgtctgtaaagtcctacaccttgaaggcgaagtaaacaaaatcaaaaacgcactattatcaacaaacaaagcagtcgtatctttatccaacggagtctcagtcctaacattcaaagtactcgatttaaaaaactacatcgataaacaactccttcccattctaaacaaacaatcctgctcaatatccaacatcgaaacagtcatagaatttcaacaaaaaaacaaccgcctgctagaaataacaagagaattttccgtaaatgccggcgtcaccacaccagtatcaacatacatgctaacaaactccgaactactctccctaataaacgatatgccaatcaccaacgaccaaaaaaaactaatgtcaaataacgttcaaatagtcagacaacaatcatacagcataatgtgcataataaaagaagaagtcttagcctacgttgtacaactcccattatacggagttatcgatacaccatgctggaaattacacacatcacccttatgcaccacaaacacaaaagaaggatccaatatttgtctaacacgaacagacagaggatggtactgtgataacgcaggatcagtgtcattctttccacaagcagaaacatgtaaagttcaatctaacagagtattctgcgacaccatgaactccctaaccttaccctcagaagtaaatctatgcaacatagatatctttaacccaaaatacgactgcaaaatcatgacatcaaaaactgacgtttcttcatccgttataacttccctcggcgctatagtgtcctgctacggaaaaactaaatgcacagcatccaacaaaaatagaggaataataaaaacattttccaacggctgcgactatgtttcaaacaaaggagtagataccgtatcagtcggcaatacattatattatgttaacaaacaagaaggaaaatccctatacgtaaaaggagaacctataatcaacttctacgacccactcgtattcccctcagacgaatttgacgcatctatatctcaagtaaatgaaaaaataaaccaatcactcgcatttatccgcaaatctgacgaattactccataacgtcaacgtcggcaaatcaaccaccaacataatgataacaacaattataatagtaataattgtcatactactactcctaatagcagtaggtctattcctatactgcaaagcaagatccacccccgtaaccctttccaaagatcaactctcaggaataaataacatagccttttcaaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12832 - RNA, 1942 nt, synthetic construct
  misc_feature 1..1942: note = mRNA product Design i-3 comprising derived and/or modified sequence from HRSV(Memphis-37)__AIY60640.1__F0_DSCav1 (opt11)
  source 1..1942: mol_type = other RNA
gggagaaagcttaccatggaactccccatactcaagactaatgccatcaccaccatcctcgccgccgtgaccctctgcttcgcatcgtcccaaaacataacagaagagttctaccaaagcacatgctccgcagtctccaaaggatacctctccgcactacgtaccggctggtacaccagcgtcatcaccatcgaactttccaacatcaaagagaacaaatgcaacggcaccgacgccaaagtaaaactcataaaacaagagctagacaaatacaaaaacgccgtcacagaactccaactactgatgcaatccacaccggccgccaacaaccgcgctcgacgtgaactcccacgcttcatgaactacactcttaacaacaccaaaaataacaacgtcaccctatccaaaaagcgaaagcgcagattcctcggcttcctacttggcgtcggctcggcgatagcctctggaatcgccgtttgcaaggtcctccacctagaaggcgaagtaaacaaaatcaaaaacgcactcctaagcaccaacaaagccgtcgtctcactttccaacggcgtctcagtcctcacattcaaagttctcgacctaaagaactacatcgacaagcaactactacccatactcaataaacaatcctgctccatcagcaacatcgagacagtcatcgaatttcaacaaaagaacaaccgcctcctcgaaattacacgcgagttctcagtcaacgccggagtcaccaccccagtctcaacatacatgctcaccaacagcgaactcctgtctctaatcaacgacatgcccatcactaacgaccagaagaaactcatgtccaacaacgtccaaatcgtgcgacaacaatcatactctatcatgtgcatcatcaaagaagaagtcctcgcatacgtcgtccagctcccactctacggcgtaatcgacacaccctgctggaaactccacacatcacccctatgcaccaccaacacaaaagaaggctccaacatctgcctaacccgaaccgacagaggttggtattgcgacaacgccggctcagtctcattcttcccacaagccgaaacctgtaaagtccaatcaaaccgcgtcttctgcgataccatgaactctctcacactcccctccgaagtcaatctctgcaacatagacatcttcaatccaaagtacgactgcaaaataatgacctcgaaaaccgacgtaagctccagcgtcatcacctccttaggcgcaatcgtatcctgctacggcaaaaccaaatgcaccgcctcaaacaaaaacagaggcatcatcaaaacgttctcgaacggatgcgactacgtttccaataaaggcgtagataccgtctccgtcggcaacacactctattacgtcaacaaacaagaaggcaaatccctctacgtcaaaggtgaacctatcatcaacttctacgaccccctcgtcttccccagcgacgagttcgatgcctcaatcagccaagtcaacgagaaaatcaaccaatcactggctttcatacgcaaatccgacgaactcctccacaacgtgaacgtcggcaaatccacaaccaacatcatgataaccacaataatcatcgtcataatcgtaatcctactcctccttattgccgtaggactattcctatactgcaaagcccgatccacccccgtcaccctctcaaaagaccaactctccggcatcaacaatatagccttctctaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12833 - protein, 553 aa, synthetic construct
  REGION 1..553: note = derived and/or modified protein sequence (artificial) from HRSV(Memphis-37)__AIY60640.1__F-del_DSCav1
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVCKVLHLEGEVNKIKNALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 12834 - RNA, 1662 nt, synthetic construct
  misc_feature 1..1662: note = derived and/or modified CDS sequence (opt1) from HRSV(Memphis-37)__AIY60640.1__F-del_DSCav1
  source 1..1662: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctga

SEQ ID NO: 12835 - RNA, 1662 nt, synthetic construct
  misc_feature 1..1662: note = derived and/or modified CDS sequence (opt1) from HRSV(Memphis-37)__AIY60640.1__F-del_DSCav1
  source 1..1662: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctga

SEQ ID NO: 12836 - RNA, 1662 nt, synthetic construct
  misc_feature 1..1662: note = derived and/or modified CDS sequence (opt2) from HRSV(Memphis-37)__AIY60640.1__F-del_DSCav1
  source 1..1662: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctga

SEQ ID NO: 12837 - RNA, 1662 nt, synthetic construct
  misc_feature 1..1662: note = derived and/or modified CDS sequence (opt3) from HRSV(Memphis-37)__AIY60640.1__F-del_DSCav1
  source 1..1662: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtga

SEQ ID NO: 12838 - RNA, 1662 nt, synthetic construct
  misc_feature 1..1662: note = derived and/or modified CDS sequence (opt4) from HRSV(Memphis-37)__AIY60640.1__F-del_DSCav1
  source 1..1662: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatga

SEQ ID NO: 12839 - RNA, 1662 nt, synthetic construct
  misc_feature 1..1662: note = derived and/or modified CDS sequence (opt5) from HRSV(Memphis-37)__AIY60640.1__F-del_DSCav1
  source 1..1662: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtga

SEQ ID NO: 12840 - RNA, 1662 nt, synthetic construct
  misc_feature 1..1662: note = derived and/or modified CDS sequence (opt6) from HRSV(Memphis-37)__AIY60640.1__F-del_DSCav1
  source 1..1662: mol_type = other RNA
atggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataa

SEQ ID NO: 12841 - RNA, 1662 nt, synthetic construct
  misc_feature 1..1662: note = derived and/or modified CDS sequence (opt11) from HRSV(Memphis-37)__AIY60640.1__F-del_DSCav1
  source 1..1662: mol_type = other RNA
atggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatag

SEQ ID NO: 12842 - RNA, 1938 nt, synthetic construct
  misc_feature 1..1938: note = mRNA product Design a-1 comprising derived and/or modified sequence from HRSV(Memphis-37)__AIY60640.1__F-del_DSCav1 (opt1)
  source 1..1938: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12843 - RNA, 1938 nt, synthetic construct
  misc_feature 1..1938: note = mRNA product Design a-1 comprising derived and/or modified sequence from HRSV(Memphis-37)__AIY60640.1__F-del_DSCav1 (opt1)
  source 1..1938: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12844 - RNA, 1938 nt, synthetic construct
  misc_feature 1..1938: note = mRNA product Design a-1 comprising derived and/or modified sequence from HRSV(Memphis-37)__AIY60640.1__F-del_DSCav1 (opt2)
  source 1..1938: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12845 - RNA, 1938 nt, synthetic construct
  misc_feature 1..1938: note = mRNA product Design a-1 comprising derived and/or modified sequence from HRSV(Memphis-37)__AIY60640.1__F-del_DSCav1 (opt3)
  source 1..1938: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12846 - RNA, 1938 nt, synthetic construct
  misc_feature 1..1938: note = mRNA product Design a-1 comprising derived and/or modified sequence from HRSV(Memphis-37)__AIY60640.1__F-del_DSCav1 (opt4)
  source 1..1938: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12847 - RNA, 1938 nt, synthetic construct
  misc_feature 1..1938: note = mRNA product Design a-1 comprising derived and/or modified sequence from HRSV(Memphis-37)__AIY60640.1__F-del_DSCav1 (opt5)
  source 1..1938: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12848 - RNA, 1938 nt, synthetic construct
  misc_feature 1..1938: note = mRNA product Design a-1 comprising derived and/or modified sequence from HRSV(Memphis-37)__AIY60640.1__F-del_DSCav1 (opt6)
  source 1..1938: mol_type = other RNA
gggagagtcccgcagtcggcgtccagcggctctgcttgttcgtgtgtgtgtcgttgcaggccttattcaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12849 - RNA, 1938 nt, synthetic construct
  misc_feature 1..1938: note = mRNA product Design a-1 comprising derived and/or modified sequence from HRSV(Memphis-37)__AIY60640.1__F-del_DSCav1 (opt11)
  source 1..1938: mol_type = other RNA
gggagagtcccgcagtcggcgtccagcggctctgcttgttcgtgtgtgtgtcgttgcaggccttattcaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12850 - RNA, 1957 nt, synthetic construct
  misc_feature 1..1957: note = mRNA product Design a-2 comprising derived and/or modified sequence from HRSV(Memphis-37)__AIY60640.1__F-del_DSCav1 (opt1)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12851 - RNA, 1957 nt, synthetic construct
  misc_feature 1..1957: note = mRNA product Design a-2 comprising derived and/or modified sequence from HRSV(Memphis-37)__AIY60640.1__F-del_DSCav1 (opt1)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12852 - RNA, 1957 nt, synthetic construct
  misc_feature 1..1957: note = mRNA product Design a-2 comprising derived and/or modified sequence from HRSV(Memphis-37)__AIY60640.1__F-del_DSCav1 (opt2)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12853 - RNA, 1957 nt, synthetic construct
  misc_feature 1..1957: note = mRNA product Design a-2 comprising derived and/or modified sequence from HRSV(Memphis-37)__AIY60640.1__F-del_DSCav1 (opt3)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12854 - RNA, 1957 nt, synthetic construct
  misc_feature 1..1957: note = mRNA product Design a-2 comprising derived and/or modified sequence from HRSV(Memphis-37)__AIY60640.1__F-del_DSCav1 (opt4)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12855 - RNA, 1957 nt, synthetic construct
  misc_feature 1..1957: note = mRNA product Design a-2 comprising derived and/or modified sequence from HRSV(Memphis-37)__AIY60640.1__F-del_DSCav1 (opt5)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12856 - RNA, 1957 nt, synthetic construct
  misc_feature 1..1957: note = mRNA product Design a-2 comprising derived and/or modified sequence from HRSV(Memphis-37)__AIY60640.1__F-del_DSCav1 (opt6)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12857 - RNA, 1957 nt, synthetic construct
  misc_feature 1..1957: note = mRNA product Design a-2 comprising derived and/or modified sequence from HRSV(Memphis-37)__AIY60640.1__F-del_DSCav1 (opt11)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12858 - RNA, 2035 nt, synthetic construct
  misc_feature 1..2035: note = mRNA product Design a-3 comprising derived and/or modified sequence from HRSV(Memphis-37)__AIY60640.1__F-del_DSCav1 (opt1)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12859 - RNA, 2035 nt, synthetic construct
  misc_feature 1..2035: note = mRNA product Design a-3 comprising derived and/or modified sequence from HRSV(Memphis-37)__AIY60640.1__F-del_DSCav1 (opt1)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12860 - RNA, 2035 nt, synthetic construct
  misc_feature 1..2035: note = mRNA product Design a-3 comprising derived and/or modified sequence from HRSV(Memphis-37)__AIY60640.1__F-del_DSCav1 (opt2)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12861 - RNA, 2035 nt, synthetic construct
  misc_feature 1..2035: note = mRNA product Design a-3 comprising derived and/or modified sequence from HRSV(Memphis-37)__AIY60640.1__F-del_DSCav1 (opt3)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12862 - RNA, 2035 nt, synthetic construct
  misc_feature 1..2035: note = mRNA product Design a-3 comprising derived and/or modified sequence from HRSV(Memphis-37)__AIY60640.1__F-del_DSCav1 (opt4)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12863 - RNA, 2035 nt, synthetic construct
  misc_feature 1..2035: note = mRNA product Design a-3 comprising derived and/or modified sequence from HRSV(Memphis-37)__AIY60640.1__F-del_DSCav1 (opt5)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12864 - RNA, 2035 nt, synthetic construct
  misc_feature 1..2035: note = mRNA product Design a-3 comprising derived and/or modified sequence from HRSV(Memphis-37)__AIY60640.1__F-del_DSCav1 (opt6)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12865 - RNA, 2035 nt, synthetic construct
  misc_feature 1..2035: note = mRNA product Design a-3 comprising derived and/or modified sequence from HRSV(Memphis-37)__AIY60640.1__F-del_DSCav1 (opt11)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12866 - RNA, 1984 nt, synthetic construct
  misc_feature 1..1984: note = mRNA product Design a-4 comprising derived and/or modified sequence from HRSV(Memphis-37)__AIY60640.1__F-del_DSCav1 (opt1)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12867 - RNA, 1984 nt, synthetic construct
  misc_feature 1..1984: note = mRNA product Design a-4 comprising derived and/or modified sequence from HRSV(Memphis-37)__AIY60640.1__F-del_DSCav1 (opt1)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12868 - RNA, 1984 nt, synthetic construct
  misc_feature 1..1984: note = mRNA product Design a-4 comprising derived and/or modified sequence from HRSV(Memphis-37)__AIY60640.1__F-del_DSCav1 (opt2)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12869 - RNA, 1984 nt, synthetic construct
  misc_feature 1..1984: note = mRNA product Design a-4 comprising derived and/or modified sequence from HRSV(Memphis-37)__AIY60640.1__F-del_DSCav1 (opt3)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12870 - RNA, 1984 nt, synthetic construct
  misc_feature 1..1984: note = mRNA product Design a-4 comprising derived and/or modified sequence from HRSV(Memphis-37)__AIY60640.1__F-del_DSCav1 (opt4)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12871 - RNA, 1984 nt, synthetic construct
  misc_feature 1..1984: note = mRNA product Design a-4 comprising derived and/or modified sequence from HRSV(Memphis-37)__AIY60640.1__F-del_DSCav1 (opt5)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12872 - RNA, 1984 nt, synthetic construct
  misc_feature 1..1984: note = mRNA product Design a-4 comprising derived and/or modified sequence from HRSV(Memphis-37)__AIY60640.1__F-del_DSCav1 (opt6)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12873 - RNA, 1984 nt, synthetic construct
  misc_feature 1..1984: note = mRNA product Design a-4 comprising derived and/or modified sequence from HRSV(Memphis-37)__AIY60640.1__F-del_DSCav1 (opt11)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12874 - RNA, 1930 nt, synthetic construct
  misc_feature 1..1930: note = mRNA product Design a-5 comprising derived and/or modified sequence from HRSV(Memphis-37)__AIY60640.1__F-del_DSCav1 (opt1)
  source 1..1930: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12875 - RNA, 1930 nt, synthetic construct
  misc_feature 1..1930: note = mRNA product Design a-5 comprising derived and/or modified sequence from HRSV(Memphis-37)__AIY60640.1__F-del_DSCav1 (opt1)
  source 1..1930: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12876 - RNA, 1930 nt, synthetic construct
  misc_feature 1..1930: note = mRNA product Design a-5 comprising derived and/or modified sequence from HRSV(Memphis-37)__AIY60640.1__F-del_DSCav1 (opt2)
  source 1..1930: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12877 - RNA, 1930 nt, synthetic construct
  misc_feature 1..1930: note = mRNA product Design a-5 comprising derived and/or modified sequence from HRSV(Memphis-37)__AIY60640.1__F-del_DSCav1 (opt3)
  source 1..1930: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12878 - RNA, 1930 nt, synthetic construct
  misc_feature 1..1930: note = mRNA product Design a-5 comprising derived and/or modified sequence from HRSV(Memphis-37)__AIY60640.1__F-del_DSCav1 (opt4)
  source 1..1930: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12879 - RNA, 1930 nt, synthetic construct
  misc_feature 1..1930: note = mRNA product Design a-5 comprising derived and/or modified sequence from HRSV(Memphis-37)__AIY60640.1__F-del_DSCav1 (opt5)
  source 1..1930: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12880 - RNA, 1930 nt, synthetic construct
  misc_feature 1..1930: note = mRNA product Design a-5 comprising derived and/or modified sequence from HRSV(Memphis-37)__AIY60640.1__F-del_DSCav1 (opt6)
  source 1..1930: mol_type = other RNA
gggagactttcccattctgtagcagaatttggtgttgcctgtggtcttggtcccgcggagaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12881 - RNA, 1930 nt, synthetic construct
  misc_feature 1..1930: note = mRNA product Design a-5 comprising derived and/or modified sequence from HRSV(Memphis-37)__AIY60640.1__F-del_DSCav1 (opt11)
  source 1..1930: mol_type = other RNA
gggagactttcccattctgtagcagaatttggtgttgcctgtggtcttggtcccgcggagaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12882 - RNA, 2111 nt, synthetic construct
  misc_feature 1..2111: note = mRNA product Design b-1 comprising derived and/or modified sequence from HRSV(Memphis-37)__AIY60640.1__F-del_DSCav1 (opt1)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12883 - RNA, 2111 nt, synthetic construct
  misc_feature 1..2111: note = mRNA product Design b-1 comprising derived and/or modified sequence from HRSV(Memphis-37)__AIY60640.1__F-del_DSCav1 (opt1)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12884 - RNA, 2111 nt, synthetic construct
  misc_feature 1..2111: note = mRNA product Design b-1 comprising derived and/or modified sequence from HRSV(Memphis-37)__AIY60640.1__F-del_DSCav1 (opt2)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12885 - RNA, 2111 nt, synthetic construct
  misc_feature 1..2111: note = mRNA product Design b-1 comprising derived and/or modified sequence from HRSV(Memphis-37)__AIY60640.1__F-del_DSCav1 (opt3)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12886 - RNA, 2111 nt, synthetic construct
  misc_feature 1..2111: note = mRNA product Design b-1 comprising derived and/or modified sequence from HRSV(Memphis-37)__AIY60640.1__F-del_DSCav1 (opt4)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12887 - RNA, 2111 nt, synthetic construct
  misc_feature 1..2111: note = mRNA product Design b-1 comprising derived and/or modified sequence from HRSV(Memphis-37)__AIY60640.1__F-del_DSCav1 (opt5)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12888 - RNA, 2111 nt, synthetic construct
  misc_feature 1..2111: note = mRNA product Design b-1 comprising derived and/or modified sequence from HRSV(Memphis-37)__AIY60640.1__F-del_DSCav1 (opt6)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12889 - RNA, 2111 nt, synthetic construct
  misc_feature 1..2111: note = mRNA product Design b-1 comprising derived and/or modified sequence from HRSV(Memphis-37)__AIY60640.1__F-del_DSCav1 (opt11)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12890 - RNA, 1931 nt, synthetic construct
  misc_feature 1..1931: note = mRNA product Design b-2 comprising derived and/or modified sequence from HRSV(Memphis-37)__AIY60640.1__F-del_DSCav1 (opt1)
  source 1..1931: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12891 - RNA, 1931 nt, synthetic construct
  misc_feature 1..1931: note = mRNA product Design b-2 comprising derived and/or modified sequence from HRSV(Memphis-37)__AIY60640.1__F-del_DSCav1 (opt1)
  source 1..1931: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12892 - RNA, 1931 nt, synthetic construct
  misc_feature 1..1931: note = mRNA product Design b-2 comprising derived and/or modified sequence from HRSV(Memphis-37)__AIY60640.1__F-del_DSCav1 (opt2)
  source 1..1931: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12893 - RNA, 1931 nt, synthetic construct
  misc_feature 1..1931: note = mRNA product Design b-2 comprising derived and/or modified sequence from HRSV(Memphis-37)__AIY60640.1__F-del_DSCav1 (opt3)
  source 1..1931: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12894 - RNA, 1931 nt, synthetic construct
  misc_feature 1..1931: note = mRNA product Design b-2 comprising derived and/or modified sequence from HRSV(Memphis-37)__AIY60640.1__F-del_DSCav1 (opt4)
  source 1..1931: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12895 - RNA, 1931 nt, synthetic construct
  misc_feature 1..1931: note = mRNA product Design b-2 comprising derived and/or modified sequence from HRSV(Memphis-37)__AIY60640.1__F-del_DSCav1 (opt5)
  source 1..1931: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12896 - RNA, 1931 nt, synthetic construct
  misc_feature 1..1931: note = mRNA product Design b-2 comprising derived and/or modified sequence from HRSV(Memphis-37)__AIY60640.1__F-del_DSCav1 (opt6)
  source 1..1931: mol_type = other RNA
gggagagcctctgctggagtccggggagtggcgttggctgctagagcgaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12897 - RNA, 1931 nt, synthetic construct
  misc_feature 1..1931: note = mRNA product Design b-2 comprising derived and/or modified sequence from HRSV(Memphis-37)__AIY60640.1__F-del_DSCav1 (opt11)
  source 1..1931: mol_type = other RNA
gggagagcctctgctggagtccggggagtggcgttggctgctagagcgaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12898 - RNA, 1951 nt, synthetic construct
  misc_feature 1..1951: note = mRNA product Design b-3 comprising derived and/or modified sequence from HRSV(Memphis-37)__AIY60640.1__F-del_DSCav1 (opt1)
  source 1..1951: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12899 - RNA, 1951 nt, synthetic construct
  misc_feature 1..1951: note = mRNA product Design b-3 comprising derived and/or modified sequence from HRSV(Memphis-37)__AIY60640.1__F-del_DSCav1 (opt1)
  source 1..1951: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12900 - RNA, 1951 nt, synthetic construct
  misc_feature 1..1951: note = mRNA product Design b-3 comprising derived and/or modified sequence from HRSV(Memphis-37)__AIY60640.1__F-del_DSCav1 (opt2)
  source 1..1951: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12901 - RNA, 1951 nt, synthetic construct
  misc_feature 1..1951: note = mRNA product Design b-3 comprising derived and/or modified sequence from HRSV(Memphis-37)__AIY60640.1__F-del_DSCav1 (opt3)
  source 1..1951: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12902 - RNA, 1951 nt, synthetic construct
  misc_feature 1..1951: note = mRNA product Design b-3 comprising derived and/or modified sequence from HRSV(Memphis-37)__AIY60640.1__F-del_DSCav1 (opt4)
  source 1..1951: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12903 - RNA, 1951 nt, synthetic construct
  misc_feature 1..1951: note = mRNA product Design b-3 comprising derived and/or modified sequence from HRSV(Memphis-37)__AIY60640.1__F-del_DSCav1 (opt5)
  source 1..1951: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12904 - RNA, 1951 nt, synthetic construct
  misc_feature 1..1951: note = mRNA product Design b-3 comprising derived and/or modified sequence from HRSV(Memphis-37)__AIY60640.1__F-del_DSCav1 (opt6)
  source 1..1951: mol_type = other RNA
gggagagtcccgcagtcggcgtccagcggctctgcttgttcgtgtgtgtgtcgttgcaggccttattcaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12905 - RNA, 1951 nt, synthetic construct
  misc_feature 1..1951: note = mRNA product Design b-3 comprising derived and/or modified sequence from HRSV(Memphis-37)__AIY60640.1__F-del_DSCav1 (opt11)
  source 1..1951: mol_type = other RNA
gggagagtcccgcagtcggcgtccagcggctctgcttgttcgtgtgtgtgtcgttgcaggccttattcaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12906 - RNA, 2002 nt, synthetic construct
  misc_feature 1..2002: note = mRNA product Design b-4 comprising derived and/or modified sequence from HRSV(Memphis-37)__AIY60640.1__F-del_DSCav1 (opt1)
  source 1..2002: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12907 - RNA, 2002 nt, synthetic construct
  misc_feature 1..2002: note = mRNA product Design b-4 comprising derived and/or modified sequence from HRSV(Memphis-37)__AIY60640.1__F-del_DSCav1 (opt1)
  source 1..2002: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12908 - RNA, 2002 nt, synthetic construct
  misc_feature 1..2002: note = mRNA product Design b-4 comprising derived and/or modified sequence from HRSV(Memphis-37)__AIY60640.1__F-del_DSCav1 (opt2)
  source 1..2002: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12909 - RNA, 2002 nt, synthetic construct
  misc_feature 1..2002: note = mRNA product Design b-4 comprising derived and/or modified sequence from HRSV(Memphis-37)__AIY60640.1__F-del_DSCav1 (opt3)
  source 1..2002: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12910 - RNA, 2002 nt, synthetic construct
  misc_feature 1..2002: note = mRNA product Design b-4 comprising derived and/or modified sequence from HRSV(Memphis-37)__AIY60640.1__F-del_DSCav1 (opt4)
  source 1..2002: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12911 - RNA, 2002 nt, synthetic construct
  misc_feature 1..2002: note = mRNA product Design b-4 comprising derived and/or modified sequence from HRSV(Memphis-37)__AIY60640.1__F-del_DSCav1 (opt5)
  source 1..2002: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12912 - RNA, 2002 nt, synthetic construct
  misc_feature 1..2002: note = mRNA product Design b-4 comprising derived and/or modified sequence from HRSV(Memphis-37)__AIY60640.1__F-del_DSCav1 (opt6)
  source 1..2002: mol_type = other RNA
gggagagtcccgcagtcggcgtccagcggctctgcttgttcgtgtgtgtgtcgttgcaggccttattcaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12913 - RNA, 2002 nt, synthetic construct
  misc_feature 1..2002: note = mRNA product Design b-4 comprising derived and/or modified sequence from HRSV(Memphis-37)__AIY60640.1__F-del_DSCav1 (opt11)
  source 1..2002: mol_type = other RNA
gggagagtcccgcagtcggcgtccagcggctctgcttgttcgtgtgtgtgtcgttgcaggccttattcaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12914 - RNA, 2064 nt, synthetic construct
  misc_feature 1..2064: note = mRNA product Design b-5 comprising derived and/or modified sequence from HRSV(Memphis-37)__AIY60640.1__F-del_DSCav1 (opt1)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12915 - RNA, 2064 nt, synthetic construct
  misc_feature 1..2064: note = mRNA product Design b-5 comprising derived and/or modified sequence from HRSV(Memphis-37)__AIY60640.1__F-del_DSCav1 (opt1)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12916 - RNA, 2064 nt, synthetic construct
  misc_feature 1..2064: note = mRNA product Design b-5 comprising derived and/or modified sequence from HRSV(Memphis-37)__AIY60640.1__F-del_DSCav1 (opt2)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12917 - RNA, 2064 nt, synthetic construct
  misc_feature 1..2064: note = mRNA product Design b-5 comprising derived and/or modified sequence from HRSV(Memphis-37)__AIY60640.1__F-del_DSCav1 (opt3)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12918 - RNA, 2064 nt, synthetic construct
  misc_feature 1..2064: note = mRNA product Design b-5 comprising derived and/or modified sequence from HRSV(Memphis-37)__AIY60640.1__F-del_DSCav1 (opt4)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12919 - RNA, 2064 nt, synthetic construct
  misc_feature 1..2064: note = mRNA product Design b-5 comprising derived and/or modified sequence from HRSV(Memphis-37)__AIY60640.1__F-del_DSCav1 (opt5)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12920 - RNA, 2064 nt, synthetic construct
  misc_feature 1..2064: note = mRNA product Design b-5 comprising derived and/or modified sequence from HRSV(Memphis-37)__AIY60640.1__F-del_DSCav1 (opt6)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12921 - RNA, 2064 nt, synthetic construct
  misc_feature 1..2064: note = mRNA product Design b-5 comprising derived and/or modified sequence from HRSV(Memphis-37)__AIY60640.1__F-del_DSCav1 (opt11)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12922 - RNA, 1970 nt, synthetic construct
  misc_feature 1..1970: note = mRNA product Design c-1 comprising derived and/or modified sequence from HRSV(Memphis-37)__AIY60640.1__F-del_DSCav1 (opt1)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12923 - RNA, 1970 nt, synthetic construct
  misc_feature 1..1970: note = mRNA product Design c-1 comprising derived and/or modified sequence from HRSV(Memphis-37)__AIY60640.1__F-del_DSCav1 (opt1)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12924 - RNA, 1970 nt, synthetic construct
  misc_feature 1..1970: note = mRNA product Design c-1 comprising derived and/or modified sequence from HRSV(Memphis-37)__AIY60640.1__F-del_DSCav1 (opt2)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12925 - RNA, 1970 nt, synthetic construct
  misc_feature 1..1970: note = mRNA product Design c-1 comprising derived and/or modified sequence from HRSV(Memphis-37)__AIY60640.1__F-del_DSCav1 (opt3)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12926 - RNA, 1970 nt, synthetic construct
  misc_feature 1..1970: note = mRNA product Design c-1 comprising derived and/or modified sequence from HRSV(Memphis-37)__AIY60640.1__F-del_DSCav1 (opt4)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12927 - RNA, 1970 nt, synthetic construct
  misc_feature 1..1970: note = mRNA product Design c-1 comprising derived and/or modified sequence from HRSV(Memphis-37)__AIY60640.1__F-del_DSCav1 (opt5)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12928 - RNA, 1970 nt, synthetic construct
  misc_feature 1..1970: note = mRNA product Design c-1 comprising derived and/or modified sequence from HRSV(Memphis-37)__AIY60640.1__F-del_DSCav1 (opt6)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12929 - RNA, 1970 nt, synthetic construct
  misc_feature 1..1970: note = mRNA product Design c-1 comprising derived and/or modified sequence from HRSV(Memphis-37)__AIY60640.1__F-del_DSCav1 (opt11)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12930 - RNA, 2060 nt, synthetic construct
  misc_feature 1..2060: note = mRNA product Design c-2 comprising derived and/or modified sequence from HRSV(Memphis-37)__AIY60640.1__F-del_DSCav1 (opt1)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12931 - RNA, 2060 nt, synthetic construct
  misc_feature 1..2060: note = mRNA product Design c-2 comprising derived and/or modified sequence from HRSV(Memphis-37)__AIY60640.1__F-del_DSCav1 (opt1)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12932 - RNA, 2060 nt, synthetic construct
  misc_feature 1..2060: note = mRNA product Design c-2 comprising derived and/or modified sequence from HRSV(Memphis-37)__AIY60640.1__F-del_DSCav1 (opt2)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12933 - RNA, 2060 nt, synthetic construct
  misc_feature 1..2060: note = mRNA product Design c-2 comprising derived and/or modified sequence from HRSV(Memphis-37)__AIY60640.1__F-del_DSCav1 (opt3)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12934 - RNA, 2060 nt, synthetic construct
  misc_feature 1..2060: note = mRNA product Design c-2 comprising derived and/or modified sequence from HRSV(Memphis-37)__AIY60640.1__F-del_DSCav1 (opt4)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12935 - RNA, 2060 nt, synthetic construct
  misc_feature 1..2060: note = mRNA product Design c-2 comprising derived and/or modified sequence from HRSV(Memphis-37)__AIY60640.1__F-del_DSCav1 (opt5)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12936 - RNA, 2060 nt, synthetic construct
  misc_feature 1..2060: note = mRNA product Design c-2 comprising derived and/or modified sequence from HRSV(Memphis-37)__AIY60640.1__F-del_DSCav1 (opt6)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12937 - RNA, 2060 nt, synthetic construct
  misc_feature 1..2060: note = mRNA product Design c-2 comprising derived and/or modified sequence from HRSV(Memphis-37)__AIY60640.1__F-del_DSCav1 (opt11)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12938 - RNA, 2037 nt, synthetic construct
  misc_feature 1..2037: note = mRNA product Design c-3 comprising derived and/or modified sequence from HRSV(Memphis-37)__AIY60640.1__F-del_DSCav1 (opt1)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12939 - RNA, 2037 nt, synthetic construct
  misc_feature 1..2037: note = mRNA product Design c-3 comprising derived and/or modified sequence from HRSV(Memphis-37)__AIY60640.1__F-del_DSCav1 (opt1)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12940 - RNA, 2037 nt, synthetic construct
  misc_feature 1..2037: note = mRNA product Design c-3 comprising derived and/or modified sequence from HRSV(Memphis-37)__AIY60640.1__F-del_DSCav1 (opt2)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12941 - RNA, 2037 nt, synthetic construct
  misc_feature 1..2037: note = mRNA product Design c-3 comprising derived and/or modified sequence from HRSV(Memphis-37)__AIY60640.1__F-del_DSCav1 (opt3)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12942 - RNA, 2037 nt, synthetic construct
  misc_feature 1..2037: note = mRNA product Design c-3 comprising derived and/or modified sequence from HRSV(Memphis-37)__AIY60640.1__F-del_DSCav1 (opt4)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12943 - RNA, 2037 nt, synthetic construct
  misc_feature 1..2037: note = mRNA product Design c-3 comprising derived and/or modified sequence from HRSV(Memphis-37)__AIY60640.1__F-del_DSCav1 (opt5)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12944 - RNA, 2037 nt, synthetic construct
  misc_feature 1..2037: note = mRNA product Design c-3 comprising derived and/or modified sequence from HRSV(Memphis-37)__AIY60640.1__F-del_DSCav1 (opt6)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12945 - RNA, 2037 nt, synthetic construct
  misc_feature 1..2037: note = mRNA product Design c-3 comprising derived and/or modified sequence from HRSV(Memphis-37)__AIY60640.1__F-del_DSCav1 (opt11)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12946 - RNA, 2033 nt, synthetic construct
  misc_feature 1..2033: note = mRNA product Design c-4 comprising derived and/or modified sequence from HRSV(Memphis-37)__AIY60640.1__F-del_DSCav1 (opt1)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12947 - RNA, 2033 nt, synthetic construct
  misc_feature 1..2033: note = mRNA product Design c-4 comprising derived and/or modified sequence from HRSV(Memphis-37)__AIY60640.1__F-del_DSCav1 (opt1)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12948 - RNA, 2033 nt, synthetic construct
  misc_feature 1..2033: note = mRNA product Design c-4 comprising derived and/or modified sequence from HRSV(Memphis-37)__AIY60640.1__F-del_DSCav1 (opt2)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12949 - RNA, 2033 nt, synthetic construct
  misc_feature 1..2033: note = mRNA product Design c-4 comprising derived and/or modified sequence from HRSV(Memphis-37)__AIY60640.1__F-del_DSCav1 (opt3)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12950 - RNA, 2033 nt, synthetic construct
  misc_feature 1..2033: note = mRNA product Design c-4 comprising derived and/or modified sequence from HRSV(Memphis-37)__AIY60640.1__F-del_DSCav1 (opt4)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12951 - RNA, 2033 nt, synthetic construct
  misc_feature 1..2033: note = mRNA product Design c-4 comprising derived and/or modified sequence from HRSV(Memphis-37)__AIY60640.1__F-del_DSCav1 (opt5)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12952 - RNA, 2033 nt, synthetic construct
  misc_feature 1..2033: note = mRNA product Design c-4 comprising derived and/or modified sequence from HRSV(Memphis-37)__AIY60640.1__F-del_DSCav1 (opt6)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12953 - RNA, 2033 nt, synthetic construct
  misc_feature 1..2033: note = mRNA product Design c-4 comprising derived and/or modified sequence from HRSV(Memphis-37)__AIY60640.1__F-del_DSCav1 (opt11)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12954 - RNA, 1951 nt, synthetic construct
  misc_feature 1..1951: note = mRNA product Design c-5 comprising derived and/or modified sequence from HRSV(Memphis-37)__AIY60640.1__F-del_DSCav1 (opt1)
  source 1..1951: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12955 - RNA, 1951 nt, synthetic construct
  misc_feature 1..1951: note = mRNA product Design c-5 comprising derived and/or modified sequence from HRSV(Memphis-37)__AIY60640.1__F-del_DSCav1 (opt1)
  source 1..1951: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12956 - RNA, 1951 nt, synthetic construct
  misc_feature 1..1951: note = mRNA product Design c-5 comprising derived and/or modified sequence from HRSV(Memphis-37)__AIY60640.1__F-del_DSCav1 (opt2)
  source 1..1951: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12957 - RNA, 1951 nt, synthetic construct
  misc_feature 1..1951: note = mRNA product Design c-5 comprising derived and/or modified sequence from HRSV(Memphis-37)__AIY60640.1__F-del_DSCav1 (opt3)
  source 1..1951: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12958 - RNA, 1951 nt, synthetic construct
  misc_feature 1..1951: note = mRNA product Design c-5 comprising derived and/or modified sequence from HRSV(Memphis-37)__AIY60640.1__F-del_DSCav1 (opt4)
  source 1..1951: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12959 - RNA, 1951 nt, synthetic construct
  misc_feature 1..1951: note = mRNA product Design c-5 comprising derived and/or modified sequence from HRSV(Memphis-37)__AIY60640.1__F-del_DSCav1 (opt5)
  source 1..1951: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12960 - RNA, 1951 nt, synthetic construct
  misc_feature 1..1951: note = mRNA product Design c-5 comprising derived and/or modified sequence from HRSV(Memphis-37)__AIY60640.1__F-del_DSCav1 (opt6)
  source 1..1951: mol_type = other RNA
gggagagcggctcggccattttgtcccagtcagtccggaggctgcggctgcagaagtaccgcctgcggagtaactgcaaagaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12961 - RNA, 1951 nt, synthetic construct
  misc_feature 1..1951: note = mRNA product Design c-5 comprising derived and/or modified sequence from HRSV(Memphis-37)__AIY60640.1__F-del_DSCav1 (opt11)
  source 1..1951: mol_type = other RNA
gggagagcggctcggccattttgtcccagtcagtccggaggctgcggctgcagaagtaccgcctgcggagtaactgcaaagaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12962 - RNA, 1960 nt, synthetic construct
  misc_feature 1..1960: note = mRNA product Design d-1 comprising derived and/or modified sequence from HRSV(Memphis-37)__AIY60640.1__F-del_DSCav1 (opt1)
  source 1..1960: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12963 - RNA, 1960 nt, synthetic construct
  misc_feature 1..1960: note = mRNA product Design d-1 comprising derived and/or modified sequence from HRSV(Memphis-37)__AIY60640.1__F-del_DSCav1 (opt1)
  source 1..1960: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12964 - RNA, 1960 nt, synthetic construct
  misc_feature 1..1960: note = mRNA product Design d-1 comprising derived and/or modified sequence from HRSV(Memphis-37)__AIY60640.1__F-del_DSCav1 (opt2)
  source 1..1960: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12965 - RNA, 1960 nt, synthetic construct
  misc_feature 1..1960: note = mRNA product Design d-1 comprising derived and/or modified sequence from HRSV(Memphis-37)__AIY60640.1__F-del_DSCav1 (opt3)
  source 1..1960: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12966 - RNA, 1960 nt, synthetic construct
  misc_feature 1..1960: note = mRNA product Design d-1 comprising derived and/or modified sequence from HRSV(Memphis-37)__AIY60640.1__F-del_DSCav1 (opt4)
  source 1..1960: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12967 - RNA, 1960 nt, synthetic construct
  misc_feature 1..1960: note = mRNA product Design d-1 comprising derived and/or modified sequence from HRSV(Memphis-37)__AIY60640.1__F-del_DSCav1 (opt5)
  source 1..1960: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12968 - RNA, 1960 nt, synthetic construct
  misc_feature 1..1960: note = mRNA product Design d-1 comprising derived and/or modified sequence from HRSV(Memphis-37)__AIY60640.1__F-del_DSCav1 (opt6)
  source 1..1960: mol_type = other RNA
gggagacccgtgacccggaagttgtacggctacgcgactttccctcccacaaaccctcgcgcccttcctttcctacttgggcccggcagaaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12969 - RNA, 1960 nt, synthetic construct
  misc_feature 1..1960: note = mRNA product Design d-1 comprising derived and/or modified sequence from HRSV(Memphis-37)__AIY60640.1__F-del_DSCav1 (opt11)
  source 1..1960: mol_type = other RNA
gggagacccgtgacccggaagttgtacggctacgcgactttccctcccacaaaccctcgcgcccttcctttcctacttgggcccggcagaaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12970 - RNA, 2015 nt, synthetic construct
  misc_feature 1..2015: note = mRNA product Design d-2 comprising derived and/or modified sequence from HRSV(Memphis-37)__AIY60640.1__F-del_DSCav1 (opt1)
  source 1..2015: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12971 - RNA, 2015 nt, synthetic construct
  misc_feature 1..2015: note = mRNA product Design d-2 comprising derived and/or modified sequence from HRSV(Memphis-37)__AIY60640.1__F-del_DSCav1 (opt1)
  source 1..2015: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12972 - RNA, 2015 nt, synthetic construct
  misc_feature 1..2015: note = mRNA product Design d-2 comprising derived and/or modified sequence from HRSV(Memphis-37)__AIY60640.1__F-del_DSCav1 (opt2)
  source 1..2015: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12973 - RNA, 2015 nt, synthetic construct
  misc_feature 1..2015: note = mRNA product Design d-2 comprising derived and/or modified sequence from HRSV(Memphis-37)__AIY60640.1__F-del_DSCav1 (opt3)
  source 1..2015: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12974 - RNA, 2015 nt, synthetic construct
  misc_feature 1..2015: note = mRNA product Design d-2 comprising derived and/or modified sequence from HRSV(Memphis-37)__AIY60640.1__F-del_DSCav1 (opt4)
  source 1..2015: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12975 - RNA, 2015 nt, synthetic construct
  misc_feature 1..2015: note = mRNA product Design d-2 comprising derived and/or modified sequence from HRSV(Memphis-37)__AIY60640.1__F-del_DSCav1 (opt5)
  source 1..2015: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12976 - RNA, 2015 nt, synthetic construct
  misc_feature 1..2015: note = mRNA product Design d-2 comprising derived and/or modified sequence from HRSV(Memphis-37)__AIY60640.1__F-del_DSCav1 (opt6)
  source 1..2015: mol_type = other RNA
gggagagcggctcggccattttgtcccagtcagtccggaggctgcggctgcagaagtaccgcctgcggagtaactgcaaagaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12977 - RNA, 2015 nt, synthetic construct
  misc_feature 1..2015: note = mRNA product Design d-2 comprising derived and/or modified sequence from HRSV(Memphis-37)__AIY60640.1__F-del_DSCav1 (opt11)
  source 1..2015: mol_type = other RNA
gggagagcggctcggccattttgtcccagtcagtccggaggctgcggctgcagaagtaccgcctgcggagtaactgcaaagaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12978 - RNA, 2331 nt, synthetic construct
  misc_feature 1..2331: note = mRNA product Design d-3 comprising derived and/or modified sequence from HRSV(Memphis-37)__AIY60640.1__F-del_DSCav1 (opt1)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12979 - RNA, 2331 nt, synthetic construct
  misc_feature 1..2331: note = mRNA product Design d-3 comprising derived and/or modified sequence from HRSV(Memphis-37)__AIY60640.1__F-del_DSCav1 (opt1)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12980 - RNA, 2331 nt, synthetic construct
  misc_feature 1..2331: note = mRNA product Design d-3 comprising derived and/or modified sequence from HRSV(Memphis-37)__AIY60640.1__F-del_DSCav1 (opt2)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12981 - RNA, 2331 nt, synthetic construct
  misc_feature 1..2331: note = mRNA product Design d-3 comprising derived and/or modified sequence from HRSV(Memphis-37)__AIY60640.1__F-del_DSCav1 (opt3)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12982 - RNA, 2331 nt, synthetic construct
  misc_feature 1..2331: note = mRNA product Design d-3 comprising derived and/or modified sequence from HRSV(Memphis-37)__AIY60640.1__F-del_DSCav1 (opt4)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12983 - RNA, 2331 nt, synthetic construct
  misc_feature 1..2331: note = mRNA product Design d-3 comprising derived and/or modified sequence from HRSV(Memphis-37)__AIY60640.1__F-del_DSCav1 (opt5)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12984 - RNA, 2331 nt, synthetic construct
  misc_feature 1..2331: note = mRNA product Design d-3 comprising derived and/or modified sequence from HRSV(Memphis-37)__AIY60640.1__F-del_DSCav1 (opt6)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12985 - RNA, 2331 nt, synthetic construct
  misc_feature 1..2331: note = mRNA product Design d-3 comprising derived and/or modified sequence from HRSV(Memphis-37)__AIY60640.1__F-del_DSCav1 (opt11)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12986 - RNA, 2014 nt, synthetic construct
  misc_feature 1..2014: note = mRNA product Design d-4 comprising derived and/or modified sequence from HRSV(Memphis-37)__AIY60640.1__F-del_DSCav1 (opt1)
  source 1..2014: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12987 - RNA, 2014 nt, synthetic construct
  misc_feature 1..2014: note = mRNA product Design d-4 comprising derived and/or modified sequence from HRSV(Memphis-37)__AIY60640.1__F-del_DSCav1 (opt1)
  source 1..2014: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12988 - RNA, 2014 nt, synthetic construct
  misc_feature 1..2014: note = mRNA product Design d-4 comprising derived and/or modified sequence from HRSV(Memphis-37)__AIY60640.1__F-del_DSCav1 (opt2)
  source 1..2014: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12989 - RNA, 2014 nt, synthetic construct
  misc_feature 1..2014: note = mRNA product Design d-4 comprising derived and/or modified sequence from HRSV(Memphis-37)__AIY60640.1__F-del_DSCav1 (opt3)
  source 1..2014: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12990 - RNA, 2014 nt, synthetic construct
  misc_feature 1..2014: note = mRNA product Design d-4 comprising derived and/or modified sequence from HRSV(Memphis-37)__AIY60640.1__F-del_DSCav1 (opt4)
  source 1..2014: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12991 - RNA, 2014 nt, synthetic construct
  misc_feature 1..2014: note = mRNA product Design d-4 comprising derived and/or modified sequence from HRSV(Memphis-37)__AIY60640.1__F-del_DSCav1 (opt5)
  source 1..2014: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12992 - RNA, 2014 nt, synthetic construct
  misc_feature 1..2014: note = mRNA product Design d-4 comprising derived and/or modified sequence from HRSV(Memphis-37)__AIY60640.1__F-del_DSCav1 (opt6)
  source 1..2014: mol_type = other RNA
gggagagtcccgcagtcggcgtccagcggctctgcttgttcgtgtgtgtgtcgttgcaggccttattcaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12993 - RNA, 2014 nt, synthetic construct
  misc_feature 1..2014: note = mRNA product Design d-4 comprising derived and/or modified sequence from HRSV(Memphis-37)__AIY60640.1__F-del_DSCav1 (opt11)
  source 1..2014: mol_type = other RNA
gggagagtcccgcagtcggcgtccagcggctctgcttgttcgtgtgtgtgtcgttgcaggccttattcaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12994 - RNA, 2111 nt, synthetic construct
  misc_feature 1..2111: note = mRNA product Design d-5 comprising derived and/or modified sequence from HRSV(Memphis-37)__AIY60640.1__F-del_DSCav1 (opt1)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12995 - RNA, 2111 nt, synthetic construct
  misc_feature 1..2111: note = mRNA product Design d-5 comprising derived and/or modified sequence from HRSV(Memphis-37)__AIY60640.1__F-del_DSCav1 (opt1)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12996 - RNA, 2111 nt, synthetic construct
  misc_feature 1..2111: note = mRNA product Design d-5 comprising derived and/or modified sequence from HRSV(Memphis-37)__AIY60640.1__F-del_DSCav1 (opt2)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12997 - RNA, 2111 nt, synthetic construct
  misc_feature 1..2111: note = mRNA product Design d-5 comprising derived and/or modified sequence from HRSV(Memphis-37)__AIY60640.1__F-del_DSCav1 (opt3)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12998 - RNA, 2111 nt, synthetic construct
  misc_feature 1..2111: note = mRNA product Design d-5 comprising derived and/or modified sequence from HRSV(Memphis-37)__AIY60640.1__F-del_DSCav1 (opt4)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 12999 - RNA, 2111 nt, synthetic construct
  misc_feature 1..2111: note = mRNA product Design d-5 comprising derived and/or modified sequence from HRSV(Memphis-37)__AIY60640.1__F-del_DSCav1 (opt5)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13000 - RNA, 2111 nt, synthetic construct
  misc_feature 1..2111: note = mRNA product Design d-5 comprising derived and/or modified sequence from HRSV(Memphis-37)__AIY60640.1__F-del_DSCav1 (opt6)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13001 - RNA, 2111 nt, synthetic construct
  misc_feature 1..2111: note = mRNA product Design d-5 comprising derived and/or modified sequence from HRSV(Memphis-37)__AIY60640.1__F-del_DSCav1 (opt11)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13002 - RNA, 1991 nt, synthetic construct
  misc_feature 1..1991: note = mRNA product Design e-1 comprising derived and/or modified sequence from HRSV(Memphis-37)__AIY60640.1__F-del_DSCav1 (opt1)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13003 - RNA, 1991 nt, synthetic construct
  misc_feature 1..1991: note = mRNA product Design e-1 comprising derived and/or modified sequence from HRSV(Memphis-37)__AIY60640.1__F-del_DSCav1 (opt1)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13004 - RNA, 1991 nt, synthetic construct
  misc_feature 1..1991: note = mRNA product Design e-1 comprising derived and/or modified sequence from HRSV(Memphis-37)__AIY60640.1__F-del_DSCav1 (opt2)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13005 - RNA, 1991 nt, synthetic construct
  misc_feature 1..1991: note = mRNA product Design e-1 comprising derived and/or modified sequence from HRSV(Memphis-37)__AIY60640.1__F-del_DSCav1 (opt3)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13006 - RNA, 1991 nt, synthetic construct
  misc_feature 1..1991: note = mRNA product Design e-1 comprising derived and/or modified sequence from HRSV(Memphis-37)__AIY60640.1__F-del_DSCav1 (opt4)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13007 - RNA, 1991 nt, synthetic construct
  misc_feature 1..1991: note = mRNA product Design e-1 comprising derived and/or modified sequence from HRSV(Memphis-37)__AIY60640.1__F-del_DSCav1 (opt5)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13008 - RNA, 1991 nt, synthetic construct
  misc_feature 1..1991: note = mRNA product Design e-1 comprising derived and/or modified sequence from HRSV(Memphis-37)__AIY60640.1__F-del_DSCav1 (opt6)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13009 - RNA, 1991 nt, synthetic construct
  misc_feature 1..1991: note = mRNA product Design e-1 comprising derived and/or modified sequence from HRSV(Memphis-37)__AIY60640.1__F-del_DSCav1 (opt11)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13010 - RNA, 1973 nt, synthetic construct
  misc_feature 1..1973: note = mRNA product Design e-2 comprising derived and/or modified sequence from HRSV(Memphis-37)__AIY60640.1__F-del_DSCav1 (opt1)
  source 1..1973: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13011 - RNA, 1973 nt, synthetic construct
  misc_feature 1..1973: note = mRNA product Design e-2 comprising derived and/or modified sequence from HRSV(Memphis-37)__AIY60640.1__F-del_DSCav1 (opt1)
  source 1..1973: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13012 - RNA, 1973 nt, synthetic construct
  misc_feature 1..1973: note = mRNA product Design e-2 comprising derived and/or modified sequence from HRSV(Memphis-37)__AIY60640.1__F-del_DSCav1 (opt2)
  source 1..1973: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13013 - RNA, 1973 nt, synthetic construct
  misc_feature 1..1973: note = mRNA product Design e-2 comprising derived and/or modified sequence from HRSV(Memphis-37)__AIY60640.1__F-del_DSCav1 (opt3)
  source 1..1973: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13014 - RNA, 1973 nt, synthetic construct
  misc_feature 1..1973: note = mRNA product Design e-2 comprising derived and/or modified sequence from HRSV(Memphis-37)__AIY60640.1__F-del_DSCav1 (opt4)
  source 1..1973: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13015 - RNA, 1973 nt, synthetic construct
  misc_feature 1..1973: note = mRNA product Design e-2 comprising derived and/or modified sequence from HRSV(Memphis-37)__AIY60640.1__F-del_DSCav1 (opt5)
  source 1..1973: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13016 - RNA, 1973 nt, synthetic construct
  misc_feature 1..1973: note = mRNA product Design e-2 comprising derived and/or modified sequence from HRSV(Memphis-37)__AIY60640.1__F-del_DSCav1 (opt6)
  source 1..1973: mol_type = other RNA
gggagacccgtgacccggaagttgtacggctacgcgactttccctcccacaaaccctcgcgcccttcctttcctacttgggcccggcagaaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13017 - RNA, 1973 nt, synthetic construct
  misc_feature 1..1973: note = mRNA product Design e-2 comprising derived and/or modified sequence from HRSV(Memphis-37)__AIY60640.1__F-del_DSCav1 (opt11)
  source 1..1973: mol_type = other RNA
gggagacccgtgacccggaagttgtacggctacgcgactttccctcccacaaaccctcgcgcccttcctttcctacttgggcccggcagaaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13018 - RNA, 1943 nt, synthetic construct
  misc_feature 1..1943: note = mRNA product Design e-3 comprising derived and/or modified sequence from HRSV(Memphis-37)__AIY60640.1__F-del_DSCav1 (opt1)
  source 1..1943: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13019 - RNA, 1943 nt, synthetic construct
  misc_feature 1..1943: note = mRNA product Design e-3 comprising derived and/or modified sequence from HRSV(Memphis-37)__AIY60640.1__F-del_DSCav1 (opt1)
  source 1..1943: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13020 - RNA, 1943 nt, synthetic construct
  misc_feature 1..1943: note = mRNA product Design e-3 comprising derived and/or modified sequence from HRSV(Memphis-37)__AIY60640.1__F-del_DSCav1 (opt2)
  source 1..1943: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13021 - RNA, 1943 nt, synthetic construct
  misc_feature 1..1943: note = mRNA product Design e-3 comprising derived and/or modified sequence from HRSV(Memphis-37)__AIY60640.1__F-del_DSCav1 (opt3)
  source 1..1943: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13022 - RNA, 1943 nt, synthetic construct
  misc_feature 1..1943: note = mRNA product Design e-3 comprising derived and/or modified sequence from HRSV(Memphis-37)__AIY60640.1__F-del_DSCav1 (opt4)
  source 1..1943: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13023 - RNA, 1943 nt, synthetic construct
  misc_feature 1..1943: note = mRNA product Design e-3 comprising derived and/or modified sequence from HRSV(Memphis-37)__AIY60640.1__F-del_DSCav1 (opt5)
  source 1..1943: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13024 - RNA, 1943 nt, synthetic construct
  misc_feature 1..1943: note = mRNA product Design e-3 comprising derived and/or modified sequence from HRSV(Memphis-37)__AIY60640.1__F-del_DSCav1 (opt6)
  source 1..1943: mol_type = other RNA
gggagactttcccattctgtagcagaatttggtgttgcctgtggtcttggtcccgcggagaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13025 - RNA, 1943 nt, synthetic construct
  misc_feature 1..1943: note = mRNA product Design e-3 comprising derived and/or modified sequence from HRSV(Memphis-37)__AIY60640.1__F-del_DSCav1 (opt11)
  source 1..1943: mol_type = other RNA
gggagactttcccattctgtagcagaatttggtgttgcctgtggtcttggtcccgcggagaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13026 - RNA, 1997 nt, synthetic construct
  misc_feature 1..1997: note = mRNA product Design e-4 comprising derived and/or modified sequence from HRSV(Memphis-37)__AIY60640.1__F-del_DSCav1 (opt1)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13027 - RNA, 1997 nt, synthetic construct
  misc_feature 1..1997: note = mRNA product Design e-4 comprising derived and/or modified sequence from HRSV(Memphis-37)__AIY60640.1__F-del_DSCav1 (opt1)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13028 - RNA, 1997 nt, synthetic construct
  misc_feature 1..1997: note = mRNA product Design e-4 comprising derived and/or modified sequence from HRSV(Memphis-37)__AIY60640.1__F-del_DSCav1 (opt2)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13029 - RNA, 1997 nt, synthetic construct
  misc_feature 1..1997: note = mRNA product Design e-4 comprising derived and/or modified sequence from HRSV(Memphis-37)__AIY60640.1__F-del_DSCav1 (opt3)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13030 - RNA, 1997 nt, synthetic construct
  misc_feature 1..1997: note = mRNA product Design e-4 comprising derived and/or modified sequence from HRSV(Memphis-37)__AIY60640.1__F-del_DSCav1 (opt4)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13031 - RNA, 1997 nt, synthetic construct
  misc_feature 1..1997: note = mRNA product Design e-4 comprising derived and/or modified sequence from HRSV(Memphis-37)__AIY60640.1__F-del_DSCav1 (opt5)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13032 - RNA, 1997 nt, synthetic construct
  misc_feature 1..1997: note = mRNA product Design e-4 comprising derived and/or modified sequence from HRSV(Memphis-37)__AIY60640.1__F-del_DSCav1 (opt6)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13033 - RNA, 1997 nt, synthetic construct
  misc_feature 1..1997: note = mRNA product Design e-4 comprising derived and/or modified sequence from HRSV(Memphis-37)__AIY60640.1__F-del_DSCav1 (opt11)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13034 - RNA, 1964 nt, synthetic construct
  misc_feature 1..1964: note = mRNA product Design e-5 comprising derived and/or modified sequence from HRSV(Memphis-37)__AIY60640.1__F-del_DSCav1 (opt1)
  source 1..1964: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13035 - RNA, 1964 nt, synthetic construct
  misc_feature 1..1964: note = mRNA product Design e-5 comprising derived and/or modified sequence from HRSV(Memphis-37)__AIY60640.1__F-del_DSCav1 (opt1)
  source 1..1964: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13036 - RNA, 1964 nt, synthetic construct
  misc_feature 1..1964: note = mRNA product Design e-5 comprising derived and/or modified sequence from HRSV(Memphis-37)__AIY60640.1__F-del_DSCav1 (opt2)
  source 1..1964: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13037 - RNA, 1964 nt, synthetic construct
  misc_feature 1..1964: note = mRNA product Design e-5 comprising derived and/or modified sequence from HRSV(Memphis-37)__AIY60640.1__F-del_DSCav1 (opt3)
  source 1..1964: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13038 - RNA, 1964 nt, synthetic construct
  misc_feature 1..1964: note = mRNA product Design e-5 comprising derived and/or modified sequence from HRSV(Memphis-37)__AIY60640.1__F-del_DSCav1 (opt4)
  source 1..1964: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13039 - RNA, 1964 nt, synthetic construct
  misc_feature 1..1964: note = mRNA product Design e-5 comprising derived and/or modified sequence from HRSV(Memphis-37)__AIY60640.1__F-del_DSCav1 (opt5)
  source 1..1964: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13040 - RNA, 1964 nt, synthetic construct
  misc_feature 1..1964: note = mRNA product Design e-5 comprising derived and/or modified sequence from HRSV(Memphis-37)__AIY60640.1__F-del_DSCav1 (opt6)
  source 1..1964: mol_type = other RNA
gggagagcggctcggccattttgtcccagtcagtccggaggctgcggctgcagaagtaccgcctgcggagtaactgcaaagaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13041 - RNA, 1964 nt, synthetic construct
  misc_feature 1..1964: note = mRNA product Design e-5 comprising derived and/or modified sequence from HRSV(Memphis-37)__AIY60640.1__F-del_DSCav1 (opt11)
  source 1..1964: mol_type = other RNA
gggagagcggctcggccattttgtcccagtcagtccggaggctgcggctgcagaagtaccgcctgcggagtaactgcaaagaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13042 - RNA, 2031 nt, synthetic construct
  misc_feature 1..2031: note = mRNA product Design e-6 comprising derived and/or modified sequence from HRSV(Memphis-37)__AIY60640.1__F-del_DSCav1 (opt1)
  source 1..2031: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13043 - RNA, 2031 nt, synthetic construct
  misc_feature 1..2031: note = mRNA product Design e-6 comprising derived and/or modified sequence from HRSV(Memphis-37)__AIY60640.1__F-del_DSCav1 (opt1)
  source 1..2031: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13044 - RNA, 2031 nt, synthetic construct
  misc_feature 1..2031: note = mRNA product Design e-6 comprising derived and/or modified sequence from HRSV(Memphis-37)__AIY60640.1__F-del_DSCav1 (opt2)
  source 1..2031: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13045 - RNA, 2031 nt, synthetic construct
  misc_feature 1..2031: note = mRNA product Design e-6 comprising derived and/or modified sequence from HRSV(Memphis-37)__AIY60640.1__F-del_DSCav1 (opt3)
  source 1..2031: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13046 - RNA, 2031 nt, synthetic construct
  misc_feature 1..2031: note = mRNA product Design e-6 comprising derived and/or modified sequence from HRSV(Memphis-37)__AIY60640.1__F-del_DSCav1 (opt4)
  source 1..2031: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13047 - RNA, 2031 nt, synthetic construct
  misc_feature 1..2031: note = mRNA product Design e-6 comprising derived and/or modified sequence from HRSV(Memphis-37)__AIY60640.1__F-del_DSCav1 (opt5)
  source 1..2031: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13048 - RNA, 2031 nt, synthetic construct
  misc_feature 1..2031: note = mRNA product Design e-6 comprising derived and/or modified sequence from HRSV(Memphis-37)__AIY60640.1__F-del_DSCav1 (opt6)
  source 1..2031: mol_type = other RNA
gggagagcggctcggccattttgtcccagtcagtccggaggctgcggctgcagaagtaccgcctgcggagtaactgcaaagaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13049 - RNA, 2031 nt, synthetic construct
  misc_feature 1..2031: note = mRNA product Design e-6 comprising derived and/or modified sequence from HRSV(Memphis-37)__AIY60640.1__F-del_DSCav1 (opt11)
  source 1..2031: mol_type = other RNA
gggagagcggctcggccattttgtcccagtcagtccggaggctgcggctgcagaagtaccgcctgcggagtaactgcaaagaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13050 - RNA, 2247 nt, synthetic construct
  misc_feature 1..2247: note = mRNA product Design f-1 comprising derived and/or modified sequence from HRSV(Memphis-37)__AIY60640.1__F-del_DSCav1 (opt1)
  source 1..2247: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13051 - RNA, 2247 nt, synthetic construct
  misc_feature 1..2247: note = mRNA product Design f-1 comprising derived and/or modified sequence from HRSV(Memphis-37)__AIY60640.1__F-del_DSCav1 (opt1)
  source 1..2247: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13052 - RNA, 2247 nt, synthetic construct
  misc_feature 1..2247: note = mRNA product Design f-1 comprising derived and/or modified sequence from HRSV(Memphis-37)__AIY60640.1__F-del_DSCav1 (opt2)
  source 1..2247: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13053 - RNA, 2247 nt, synthetic construct
  misc_feature 1..2247: note = mRNA product Design f-1 comprising derived and/or modified sequence from HRSV(Memphis-37)__AIY60640.1__F-del_DSCav1 (opt3)
  source 1..2247: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13054 - RNA, 2247 nt, synthetic construct
  misc_feature 1..2247: note = mRNA product Design f-1 comprising derived and/or modified sequence from HRSV(Memphis-37)__AIY60640.1__F-del_DSCav1 (opt4)
  source 1..2247: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13055 - RNA, 2247 nt, synthetic construct
  misc_feature 1..2247: note = mRNA product Design f-1 comprising derived and/or modified sequence from HRSV(Memphis-37)__AIY60640.1__F-del_DSCav1 (opt5)
  source 1..2247: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13056 - RNA, 2247 nt, synthetic construct
  misc_feature 1..2247: note = mRNA product Design f-1 comprising derived and/or modified sequence from HRSV(Memphis-37)__AIY60640.1__F-del_DSCav1 (opt6)
  source 1..2247: mol_type = other RNA
gggagagcggctcggccattttgtcccagtcagtccggaggctgcggctgcagaagtaccgcctgcggagtaactgcaaagaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13057 - RNA, 2247 nt, synthetic construct
  misc_feature 1..2247: note = mRNA product Design f-1 comprising derived and/or modified sequence from HRSV(Memphis-37)__AIY60640.1__F-del_DSCav1 (opt11)
  source 1..2247: mol_type = other RNA
gggagagcggctcggccattttgtcccagtcagtccggaggctgcggctgcagaagtaccgcctgcggagtaactgcaaagaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13058 - RNA, 2027 nt, synthetic construct
  misc_feature 1..2027: note = mRNA product Design f-2 comprising derived and/or modified sequence from HRSV(Memphis-37)__AIY60640.1__F-del_DSCav1 (opt1)
  source 1..2027: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13059 - RNA, 2027 nt, synthetic construct
  misc_feature 1..2027: note = mRNA product Design f-2 comprising derived and/or modified sequence from HRSV(Memphis-37)__AIY60640.1__F-del_DSCav1 (opt1)
  source 1..2027: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13060 - RNA, 2027 nt, synthetic construct
  misc_feature 1..2027: note = mRNA product Design f-2 comprising derived and/or modified sequence from HRSV(Memphis-37)__AIY60640.1__F-del_DSCav1 (opt2)
  source 1..2027: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13061 - RNA, 2027 nt, synthetic construct
  misc_feature 1..2027: note = mRNA product Design f-2 comprising derived and/or modified sequence from HRSV(Memphis-37)__AIY60640.1__F-del_DSCav1 (opt3)
  source 1..2027: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13062 - RNA, 2027 nt, synthetic construct
  misc_feature 1..2027: note = mRNA product Design f-2 comprising derived and/or modified sequence from HRSV(Memphis-37)__AIY60640.1__F-del_DSCav1 (opt4)
  source 1..2027: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13063 - RNA, 2027 nt, synthetic construct
  misc_feature 1..2027: note = mRNA product Design f-2 comprising derived and/or modified sequence from HRSV(Memphis-37)__AIY60640.1__F-del_DSCav1 (opt5)
  source 1..2027: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13064 - RNA, 2027 nt, synthetic construct
  misc_feature 1..2027: note = mRNA product Design f-2 comprising derived and/or modified sequence from HRSV(Memphis-37)__AIY60640.1__F-del_DSCav1 (opt6)
  source 1..2027: mol_type = other RNA
gggagagcggctcggccattttgtcccagtcagtccggaggctgcggctgcagaagtaccgcctgcggagtaactgcaaagaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13065 - RNA, 2027 nt, synthetic construct
  misc_feature 1..2027: note = mRNA product Design f-2 comprising derived and/or modified sequence from HRSV(Memphis-37)__AIY60640.1__F-del_DSCav1 (opt11)
  source 1..2027: mol_type = other RNA
gggagagcggctcggccattttgtcccagtcagtccggaggctgcggctgcagaagtaccgcctgcggagtaactgcaaagaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13066 - RNA, 2018 nt, synthetic construct
  misc_feature 1..2018: note = mRNA product Design f-3 comprising derived and/or modified sequence from HRSV(Memphis-37)__AIY60640.1__F-del_DSCav1 (opt1)
  source 1..2018: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13067 - RNA, 2018 nt, synthetic construct
  misc_feature 1..2018: note = mRNA product Design f-3 comprising derived and/or modified sequence from HRSV(Memphis-37)__AIY60640.1__F-del_DSCav1 (opt1)
  source 1..2018: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13068 - RNA, 2018 nt, synthetic construct
  misc_feature 1..2018: note = mRNA product Design f-3 comprising derived and/or modified sequence from HRSV(Memphis-37)__AIY60640.1__F-del_DSCav1 (opt2)
  source 1..2018: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13069 - RNA, 2018 nt, synthetic construct
  misc_feature 1..2018: note = mRNA product Design f-3 comprising derived and/or modified sequence from HRSV(Memphis-37)__AIY60640.1__F-del_DSCav1 (opt3)
  source 1..2018: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13070 - RNA, 2018 nt, synthetic construct
  misc_feature 1..2018: note = mRNA product Design f-3 comprising derived and/or modified sequence from HRSV(Memphis-37)__AIY60640.1__F-del_DSCav1 (opt4)
  source 1..2018: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13071 - RNA, 2018 nt, synthetic construct
  misc_feature 1..2018: note = mRNA product Design f-3 comprising derived and/or modified sequence from HRSV(Memphis-37)__AIY60640.1__F-del_DSCav1 (opt5)
  source 1..2018: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13072 - RNA, 2018 nt, synthetic construct
  misc_feature 1..2018: note = mRNA product Design f-3 comprising derived and/or modified sequence from HRSV(Memphis-37)__AIY60640.1__F-del_DSCav1 (opt6)
  source 1..2018: mol_type = other RNA
gggagagtcccgcagtcggcgtccagcggctctgcttgttcgtgtgtgtgtcgttgcaggccttattcaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13073 - RNA, 2018 nt, synthetic construct
  misc_feature 1..2018: note = mRNA product Design f-3 comprising derived and/or modified sequence from HRSV(Memphis-37)__AIY60640.1__F-del_DSCav1 (opt11)
  source 1..2018: mol_type = other RNA
gggagagtcccgcagtcggcgtccagcggctctgcttgttcgtgtgtgtgtcgttgcaggccttattcaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13074 - RNA, 2234 nt, synthetic construct
  misc_feature 1..2234: note = mRNA product Design f-4 comprising derived and/or modified sequence from HRSV(Memphis-37)__AIY60640.1__F-del_DSCav1 (opt1)
  source 1..2234: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13075 - RNA, 2234 nt, synthetic construct
  misc_feature 1..2234: note = mRNA product Design f-4 comprising derived and/or modified sequence from HRSV(Memphis-37)__AIY60640.1__F-del_DSCav1 (opt1)
  source 1..2234: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13076 - RNA, 2234 nt, synthetic construct
  misc_feature 1..2234: note = mRNA product Design f-4 comprising derived and/or modified sequence from HRSV(Memphis-37)__AIY60640.1__F-del_DSCav1 (opt2)
  source 1..2234: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13077 - RNA, 2234 nt, synthetic construct
  misc_feature 1..2234: note = mRNA product Design f-4 comprising derived and/or modified sequence from HRSV(Memphis-37)__AIY60640.1__F-del_DSCav1 (opt3)
  source 1..2234: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13078 - RNA, 2234 nt, synthetic construct
  misc_feature 1..2234: note = mRNA product Design f-4 comprising derived and/or modified sequence from HRSV(Memphis-37)__AIY60640.1__F-del_DSCav1 (opt4)
  source 1..2234: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13079 - RNA, 2234 nt, synthetic construct
  misc_feature 1..2234: note = mRNA product Design f-4 comprising derived and/or modified sequence from HRSV(Memphis-37)__AIY60640.1__F-del_DSCav1 (opt5)
  source 1..2234: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13080 - RNA, 2234 nt, synthetic construct
  misc_feature 1..2234: note = mRNA product Design f-4 comprising derived and/or modified sequence from HRSV(Memphis-37)__AIY60640.1__F-del_DSCav1 (opt6)
  source 1..2234: mol_type = other RNA
gggagagtcccgcagtcggcgtccagcggctctgcttgttcgtgtgtgtgtcgttgcaggccttattcaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13081 - RNA, 2234 nt, synthetic construct
  misc_feature 1..2234: note = mRNA product Design f-4 comprising derived and/or modified sequence from HRSV(Memphis-37)__AIY60640.1__F-del_DSCav1 (opt11)
  source 1..2234: mol_type = other RNA
gggagagtcccgcagtcggcgtccagcggctctgcttgttcgtgtgtgtgtcgttgcaggccttattcaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13082 - RNA, 2010 nt, synthetic construct
  misc_feature 1..2010: note = mRNA product Design f-5 comprising derived and/or modified sequence from HRSV(Memphis-37)__AIY60640.1__F-del_DSCav1 (opt1)
  source 1..2010: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13083 - RNA, 2010 nt, synthetic construct
  misc_feature 1..2010: note = mRNA product Design f-5 comprising derived and/or modified sequence from HRSV(Memphis-37)__AIY60640.1__F-del_DSCav1 (opt1)
  source 1..2010: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13084 - RNA, 2010 nt, synthetic construct
  misc_feature 1..2010: note = mRNA product Design f-5 comprising derived and/or modified sequence from HRSV(Memphis-37)__AIY60640.1__F-del_DSCav1 (opt2)
  source 1..2010: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13085 - RNA, 2010 nt, synthetic construct
  misc_feature 1..2010: note = mRNA product Design f-5 comprising derived and/or modified sequence from HRSV(Memphis-37)__AIY60640.1__F-del_DSCav1 (opt3)
  source 1..2010: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13086 - RNA, 2010 nt, synthetic construct
  misc_feature 1..2010: note = mRNA product Design f-5 comprising derived and/or modified sequence from HRSV(Memphis-37)__AIY60640.1__F-del_DSCav1 (opt4)
  source 1..2010: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13087 - RNA, 2010 nt, synthetic construct
  misc_feature 1..2010: note = mRNA product Design f-5 comprising derived and/or modified sequence from HRSV(Memphis-37)__AIY60640.1__F-del_DSCav1 (opt5)
  source 1..2010: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13088 - RNA, 2010 nt, synthetic construct
  misc_feature 1..2010: note = mRNA product Design f-5 comprising derived and/or modified sequence from HRSV(Memphis-37)__AIY60640.1__F-del_DSCav1 (opt6)
  source 1..2010: mol_type = other RNA
gggagactttcccattctgtagcagaatttggtgttgcctgtggtcttggtcccgcggagaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13089 - RNA, 2010 nt, synthetic construct
  misc_feature 1..2010: note = mRNA product Design f-5 comprising derived and/or modified sequence from HRSV(Memphis-37)__AIY60640.1__F-del_DSCav1 (opt11)
  source 1..2010: mol_type = other RNA
gggagactttcccattctgtagcagaatttggtgttgcctgtggtcttggtcccgcggagaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13090 - RNA, 2006 nt, synthetic construct
  misc_feature 1..2006: note = mRNA product Design g-1 comprising derived and/or modified sequence from HRSV(Memphis-37)__AIY60640.1__F-del_DSCav1 (opt1)
  source 1..2006: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13091 - RNA, 2006 nt, synthetic construct
  misc_feature 1..2006: note = mRNA product Design g-1 comprising derived and/or modified sequence from HRSV(Memphis-37)__AIY60640.1__F-del_DSCav1 (opt1)
  source 1..2006: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13092 - RNA, 2006 nt, synthetic construct
  misc_feature 1..2006: note = mRNA product Design g-1 comprising derived and/or modified sequence from HRSV(Memphis-37)__AIY60640.1__F-del_DSCav1 (opt2)
  source 1..2006: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13093 - RNA, 2006 nt, synthetic construct
  misc_feature 1..2006: note = mRNA product Design g-1 comprising derived and/or modified sequence from HRSV(Memphis-37)__AIY60640.1__F-del_DSCav1 (opt3)
  source 1..2006: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13094 - RNA, 2006 nt, synthetic construct
  misc_feature 1..2006: note = mRNA product Design g-1 comprising derived and/or modified sequence from HRSV(Memphis-37)__AIY60640.1__F-del_DSCav1 (opt4)
  source 1..2006: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13095 - RNA, 2006 nt, synthetic construct
  misc_feature 1..2006: note = mRNA product Design g-1 comprising derived and/or modified sequence from HRSV(Memphis-37)__AIY60640.1__F-del_DSCav1 (opt5)
  source 1..2006: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13096 - RNA, 2006 nt, synthetic construct
  misc_feature 1..2006: note = mRNA product Design g-1 comprising derived and/or modified sequence from HRSV(Memphis-37)__AIY60640.1__F-del_DSCav1 (opt6)
  source 1..2006: mol_type = other RNA
gggagactttcccattctgtagcagaatttggtgttgcctgtggtcttggtcccgcggagaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13097 - RNA, 2006 nt, synthetic construct
  misc_feature 1..2006: note = mRNA product Design g-1 comprising derived and/or modified sequence from HRSV(Memphis-37)__AIY60640.1__F-del_DSCav1 (opt11)
  source 1..2006: mol_type = other RNA
gggagactttcccattctgtagcagaatttggtgttgcctgtggtcttggtcccgcggagaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13098 - RNA, 2021 nt, synthetic construct
  misc_feature 1..2021: note = mRNA product Design g-2 comprising derived and/or modified sequence from HRSV(Memphis-37)__AIY60640.1__F-del_DSCav1 (opt1)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13099 - RNA, 2021 nt, synthetic construct
  misc_feature 1..2021: note = mRNA product Design g-2 comprising derived and/or modified sequence from HRSV(Memphis-37)__AIY60640.1__F-del_DSCav1 (opt1)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13100 - RNA, 2021 nt, synthetic construct
  misc_feature 1..2021: note = mRNA product Design g-2 comprising derived and/or modified sequence from HRSV(Memphis-37)__AIY60640.1__F-del_DSCav1 (opt2)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13101 - RNA, 2021 nt, synthetic construct
  misc_feature 1..2021: note = mRNA product Design g-2 comprising derived and/or modified sequence from HRSV(Memphis-37)__AIY60640.1__F-del_DSCav1 (opt3)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13102 - RNA, 2021 nt, synthetic construct
  misc_feature 1..2021: note = mRNA product Design g-2 comprising derived and/or modified sequence from HRSV(Memphis-37)__AIY60640.1__F-del_DSCav1 (opt4)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13103 - RNA, 2021 nt, synthetic construct
  misc_feature 1..2021: note = mRNA product Design g-2 comprising derived and/or modified sequence from HRSV(Memphis-37)__AIY60640.1__F-del_DSCav1 (opt5)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13104 - RNA, 2021 nt, synthetic construct
  misc_feature 1..2021: note = mRNA product Design g-2 comprising derived and/or modified sequence from HRSV(Memphis-37)__AIY60640.1__F-del_DSCav1 (opt6)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13105 - RNA, 2021 nt, synthetic construct
  misc_feature 1..2021: note = mRNA product Design g-2 comprising derived and/or modified sequence from HRSV(Memphis-37)__AIY60640.1__F-del_DSCav1 (opt11)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13106 - RNA, 2253 nt, synthetic construct
  misc_feature 1..2253: note = mRNA product Design g-3 comprising derived and/or modified sequence from HRSV(Memphis-37)__AIY60640.1__F-del_DSCav1 (opt1)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13107 - RNA, 2253 nt, synthetic construct
  misc_feature 1..2253: note = mRNA product Design g-3 comprising derived and/or modified sequence from HRSV(Memphis-37)__AIY60640.1__F-del_DSCav1 (opt1)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13108 - RNA, 2253 nt, synthetic construct
  misc_feature 1..2253: note = mRNA product Design g-3 comprising derived and/or modified sequence from HRSV(Memphis-37)__AIY60640.1__F-del_DSCav1 (opt2)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13109 - RNA, 2253 nt, synthetic construct
  misc_feature 1..2253: note = mRNA product Design g-3 comprising derived and/or modified sequence from HRSV(Memphis-37)__AIY60640.1__F-del_DSCav1 (opt3)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13110 - RNA, 2253 nt, synthetic construct
  misc_feature 1..2253: note = mRNA product Design g-3 comprising derived and/or modified sequence from HRSV(Memphis-37)__AIY60640.1__F-del_DSCav1 (opt4)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13111 - RNA, 2253 nt, synthetic construct
  misc_feature 1..2253: note = mRNA product Design g-3 comprising derived and/or modified sequence from HRSV(Memphis-37)__AIY60640.1__F-del_DSCav1 (opt5)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13112 - RNA, 2253 nt, synthetic construct
  misc_feature 1..2253: note = mRNA product Design g-3 comprising derived and/or modified sequence from HRSV(Memphis-37)__AIY60640.1__F-del_DSCav1 (opt6)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13113 - RNA, 2253 nt, synthetic construct
  misc_feature 1..2253: note = mRNA product Design g-3 comprising derived and/or modified sequence from HRSV(Memphis-37)__AIY60640.1__F-del_DSCav1 (opt11)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13114 - RNA, 2048 nt, synthetic construct
  misc_feature 1..2048: note = mRNA product Design g-4 comprising derived and/or modified sequence from HRSV(Memphis-37)__AIY60640.1__F-del_DSCav1 (opt1)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13115 - RNA, 2048 nt, synthetic construct
  misc_feature 1..2048: note = mRNA product Design g-4 comprising derived and/or modified sequence from HRSV(Memphis-37)__AIY60640.1__F-del_DSCav1 (opt1)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13116 - RNA, 2048 nt, synthetic construct
  misc_feature 1..2048: note = mRNA product Design g-4 comprising derived and/or modified sequence from HRSV(Memphis-37)__AIY60640.1__F-del_DSCav1 (opt2)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13117 - RNA, 2048 nt, synthetic construct
  misc_feature 1..2048: note = mRNA product Design g-4 comprising derived and/or modified sequence from HRSV(Memphis-37)__AIY60640.1__F-del_DSCav1 (opt3)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13118 - RNA, 2048 nt, synthetic construct
  misc_feature 1..2048: note = mRNA product Design g-4 comprising derived and/or modified sequence from HRSV(Memphis-37)__AIY60640.1__F-del_DSCav1 (opt4)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13119 - RNA, 2048 nt, synthetic construct
  misc_feature 1..2048: note = mRNA product Design g-4 comprising derived and/or modified sequence from HRSV(Memphis-37)__AIY60640.1__F-del_DSCav1 (opt5)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13120 - RNA, 2048 nt, synthetic construct
  misc_feature 1..2048: note = mRNA product Design g-4 comprising derived and/or modified sequence from HRSV(Memphis-37)__AIY60640.1__F-del_DSCav1 (opt6)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13121 - RNA, 2048 nt, synthetic construct
  misc_feature 1..2048: note = mRNA product Design g-4 comprising derived and/or modified sequence from HRSV(Memphis-37)__AIY60640.1__F-del_DSCav1 (opt11)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13122 - RNA, 2024 nt, synthetic construct
  misc_feature 1..2024: note = mRNA product Design g-5 comprising derived and/or modified sequence from HRSV(Memphis-37)__AIY60640.1__F-del_DSCav1 (opt1)
  source 1..2024: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13123 - RNA, 2024 nt, synthetic construct
  misc_feature 1..2024: note = mRNA product Design g-5 comprising derived and/or modified sequence from HRSV(Memphis-37)__AIY60640.1__F-del_DSCav1 (opt1)
  source 1..2024: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13124 - RNA, 2024 nt, synthetic construct
  misc_feature 1..2024: note = mRNA product Design g-5 comprising derived and/or modified sequence from HRSV(Memphis-37)__AIY60640.1__F-del_DSCav1 (opt2)
  source 1..2024: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13125 - RNA, 2024 nt, synthetic construct
  misc_feature 1..2024: note = mRNA product Design g-5 comprising derived and/or modified sequence from HRSV(Memphis-37)__AIY60640.1__F-del_DSCav1 (opt3)
  source 1..2024: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13126 - RNA, 2024 nt, synthetic construct
  misc_feature 1..2024: note = mRNA product Design g-5 comprising derived and/or modified sequence from HRSV(Memphis-37)__AIY60640.1__F-del_DSCav1 (opt4)
  source 1..2024: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13127 - RNA, 2024 nt, synthetic construct
  misc_feature 1..2024: note = mRNA product Design g-5 comprising derived and/or modified sequence from HRSV(Memphis-37)__AIY60640.1__F-del_DSCav1 (opt5)
  source 1..2024: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13128 - RNA, 2024 nt, synthetic construct
  misc_feature 1..2024: note = mRNA product Design g-5 comprising derived and/or modified sequence from HRSV(Memphis-37)__AIY60640.1__F-del_DSCav1 (opt6)
  source 1..2024: mol_type = other RNA
gggagacccgtgacccggaagttgtacggctacgcgactttccctcccacaaaccctcgcgcccttcctttcctacttgggcccggcagaaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13129 - RNA, 2024 nt, synthetic construct
  misc_feature 1..2024: note = mRNA product Design g-5 comprising derived and/or modified sequence from HRSV(Memphis-37)__AIY60640.1__F-del_DSCav1 (opt11)
  source 1..2024: mol_type = other RNA
gggagacccgtgacccggaagttgtacggctacgcgactttccctcccacaaaccctcgcgcccttcctttcctacttgggcccggcagaaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13130 - RNA, 2040 nt, synthetic construct
  misc_feature 1..2040: note = mRNA product Design h-1 comprising derived and/or modified sequence from HRSV(Memphis-37)__AIY60640.1__F-del_DSCav1 (opt1)
  source 1..2040: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13131 - RNA, 2040 nt, synthetic construct
  misc_feature 1..2040: note = mRNA product Design h-1 comprising derived and/or modified sequence from HRSV(Memphis-37)__AIY60640.1__F-del_DSCav1 (opt1)
  source 1..2040: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13132 - RNA, 2040 nt, synthetic construct
  misc_feature 1..2040: note = mRNA product Design h-1 comprising derived and/or modified sequence from HRSV(Memphis-37)__AIY60640.1__F-del_DSCav1 (opt2)
  source 1..2040: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13133 - RNA, 2040 nt, synthetic construct
  misc_feature 1..2040: note = mRNA product Design h-1 comprising derived and/or modified sequence from HRSV(Memphis-37)__AIY60640.1__F-del_DSCav1 (opt3)
  source 1..2040: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13134 - RNA, 2040 nt, synthetic construct
  misc_feature 1..2040: note = mRNA product Design h-1 comprising derived and/or modified sequence from HRSV(Memphis-37)__AIY60640.1__F-del_DSCav1 (opt4)
  source 1..2040: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13135 - RNA, 2040 nt, synthetic construct
  misc_feature 1..2040: note = mRNA product Design h-1 comprising derived and/or modified sequence from HRSV(Memphis-37)__AIY60640.1__F-del_DSCav1 (opt5)
  source 1..2040: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13136 - RNA, 2040 nt, synthetic construct
  misc_feature 1..2040: note = mRNA product Design h-1 comprising derived and/or modified sequence from HRSV(Memphis-37)__AIY60640.1__F-del_DSCav1 (opt6)
  source 1..2040: mol_type = other RNA
gggagacccgtgacccggaagttgtacggctacgcgactttccctcccacaaaccctcgcgcccttcctttcctacttgggcccggcagaaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13137 - RNA, 2040 nt, synthetic construct
  misc_feature 1..2040: note = mRNA product Design h-1 comprising derived and/or modified sequence from HRSV(Memphis-37)__AIY60640.1__F-del_DSCav1 (opt11)
  source 1..2040: mol_type = other RNA
gggagacccgtgacccggaagttgtacggctacgcgactttccctcccacaaaccctcgcgcccttcctttcctacttgggcccggcagaaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13138 - RNA, 2256 nt, synthetic construct
  misc_feature 1..2256: note = mRNA product Design h-2 comprising derived and/or modified sequence from HRSV(Memphis-37)__AIY60640.1__F-del_DSCav1 (opt1)
  source 1..2256: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13139 - RNA, 2256 nt, synthetic construct
  misc_feature 1..2256: note = mRNA product Design h-2 comprising derived and/or modified sequence from HRSV(Memphis-37)__AIY60640.1__F-del_DSCav1 (opt1)
  source 1..2256: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13140 - RNA, 2256 nt, synthetic construct
  misc_feature 1..2256: note = mRNA product Design h-2 comprising derived and/or modified sequence from HRSV(Memphis-37)__AIY60640.1__F-del_DSCav1 (opt2)
  source 1..2256: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13141 - RNA, 2256 nt, synthetic construct
  misc_feature 1..2256: note = mRNA product Design h-2 comprising derived and/or modified sequence from HRSV(Memphis-37)__AIY60640.1__F-del_DSCav1 (opt3)
  source 1..2256: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13142 - RNA, 2256 nt, synthetic construct
  misc_feature 1..2256: note = mRNA product Design h-2 comprising derived and/or modified sequence from HRSV(Memphis-37)__AIY60640.1__F-del_DSCav1 (opt4)
  source 1..2256: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13143 - RNA, 2256 nt, synthetic construct
  misc_feature 1..2256: note = mRNA product Design h-2 comprising derived and/or modified sequence from HRSV(Memphis-37)__AIY60640.1__F-del_DSCav1 (opt5)
  source 1..2256: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13144 - RNA, 2256 nt, synthetic construct
  misc_feature 1..2256: note = mRNA product Design h-2 comprising derived and/or modified sequence from HRSV(Memphis-37)__AIY60640.1__F-del_DSCav1 (opt6)
  source 1..2256: mol_type = other RNA
gggagacccgtgacccggaagttgtacggctacgcgactttccctcccacaaaccctcgcgcccttcctttcctacttgggcccggcagaaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13145 - RNA, 2256 nt, synthetic construct
  misc_feature 1..2256: note = mRNA product Design h-2 comprising derived and/or modified sequence from HRSV(Memphis-37)__AIY60640.1__F-del_DSCav1 (opt11)
  source 1..2256: mol_type = other RNA
gggagacccgtgacccggaagttgtacggctacgcgactttccctcccacaaaccctcgcgcccttcctttcctacttgggcccggcagaaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13146 - RNA, 2036 nt, synthetic construct
  misc_feature 1..2036: note = mRNA product Design h-3 comprising derived and/or modified sequence from HRSV(Memphis-37)__AIY60640.1__F-del_DSCav1 (opt1)
  source 1..2036: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13147 - RNA, 2036 nt, synthetic construct
  misc_feature 1..2036: note = mRNA product Design h-3 comprising derived and/or modified sequence from HRSV(Memphis-37)__AIY60640.1__F-del_DSCav1 (opt1)
  source 1..2036: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13148 - RNA, 2036 nt, synthetic construct
  misc_feature 1..2036: note = mRNA product Design h-3 comprising derived and/or modified sequence from HRSV(Memphis-37)__AIY60640.1__F-del_DSCav1 (opt2)
  source 1..2036: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13149 - RNA, 2036 nt, synthetic construct
  misc_feature 1..2036: note = mRNA product Design h-3 comprising derived and/or modified sequence from HRSV(Memphis-37)__AIY60640.1__F-del_DSCav1 (opt3)
  source 1..2036: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13150 - RNA, 2036 nt, synthetic construct
  misc_feature 1..2036: note = mRNA product Design h-3 comprising derived and/or modified sequence from HRSV(Memphis-37)__AIY60640.1__F-del_DSCav1 (opt4)
  source 1..2036: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13151 - RNA, 2036 nt, synthetic construct
  misc_feature 1..2036: note = mRNA product Design h-3 comprising derived and/or modified sequence from HRSV(Memphis-37)__AIY60640.1__F-del_DSCav1 (opt5)
  source 1..2036: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13152 - RNA, 2036 nt, synthetic construct
  misc_feature 1..2036: note = mRNA product Design h-3 comprising derived and/or modified sequence from HRSV(Memphis-37)__AIY60640.1__F-del_DSCav1 (opt6)
  source 1..2036: mol_type = other RNA
gggagacccgtgacccggaagttgtacggctacgcgactttccctcccacaaaccctcgcgcccttcctttcctacttgggcccggcagaaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13153 - RNA, 2036 nt, synthetic construct
  misc_feature 1..2036: note = mRNA product Design h-3 comprising derived and/or modified sequence from HRSV(Memphis-37)__AIY60640.1__F-del_DSCav1 (opt11)
  source 1..2036: mol_type = other RNA
gggagacccgtgacccggaagttgtacggctacgcgactttccctcccacaaaccctcgcgcccttcctttcctacttgggcccggcagaaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13154 - RNA, 2099 nt, synthetic construct
  misc_feature 1..2099: note = mRNA product Design h-4 comprising derived and/or modified sequence from HRSV(Memphis-37)__AIY60640.1__F-del_DSCav1 (opt1)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13155 - RNA, 2099 nt, synthetic construct
  misc_feature 1..2099: note = mRNA product Design h-4 comprising derived and/or modified sequence from HRSV(Memphis-37)__AIY60640.1__F-del_DSCav1 (opt1)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13156 - RNA, 2099 nt, synthetic construct
  misc_feature 1..2099: note = mRNA product Design h-4 comprising derived and/or modified sequence from HRSV(Memphis-37)__AIY60640.1__F-del_DSCav1 (opt2)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13157 - RNA, 2099 nt, synthetic construct
  misc_feature 1..2099: note = mRNA product Design h-4 comprising derived and/or modified sequence from HRSV(Memphis-37)__AIY60640.1__F-del_DSCav1 (opt3)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13158 - RNA, 2099 nt, synthetic construct
  misc_feature 1..2099: note = mRNA product Design h-4 comprising derived and/or modified sequence from HRSV(Memphis-37)__AIY60640.1__F-del_DSCav1 (opt4)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13159 - RNA, 2099 nt, synthetic construct
  misc_feature 1..2099: note = mRNA product Design h-4 comprising derived and/or modified sequence from HRSV(Memphis-37)__AIY60640.1__F-del_DSCav1 (opt5)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13160 - RNA, 2099 nt, synthetic construct
  misc_feature 1..2099: note = mRNA product Design h-4 comprising derived and/or modified sequence from HRSV(Memphis-37)__AIY60640.1__F-del_DSCav1 (opt6)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13161 - RNA, 2099 nt, synthetic construct
  misc_feature 1..2099: note = mRNA product Design h-4 comprising derived and/or modified sequence from HRSV(Memphis-37)__AIY60640.1__F-del_DSCav1 (opt11)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13162 - RNA, 2115 nt, synthetic construct
  misc_feature 1..2115: note = mRNA product Design h-5 comprising derived and/or modified sequence from HRSV(Memphis-37)__AIY60640.1__F-del_DSCav1 (opt1)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13163 - RNA, 2115 nt, synthetic construct
  misc_feature 1..2115: note = mRNA product Design h-5 comprising derived and/or modified sequence from HRSV(Memphis-37)__AIY60640.1__F-del_DSCav1 (opt1)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13164 - RNA, 2115 nt, synthetic construct
  misc_feature 1..2115: note = mRNA product Design h-5 comprising derived and/or modified sequence from HRSV(Memphis-37)__AIY60640.1__F-del_DSCav1 (opt2)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13165 - RNA, 2115 nt, synthetic construct
  misc_feature 1..2115: note = mRNA product Design h-5 comprising derived and/or modified sequence from HRSV(Memphis-37)__AIY60640.1__F-del_DSCav1 (opt3)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13166 - RNA, 2115 nt, synthetic construct
  misc_feature 1..2115: note = mRNA product Design h-5 comprising derived and/or modified sequence from HRSV(Memphis-37)__AIY60640.1__F-del_DSCav1 (opt4)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13167 - RNA, 2115 nt, synthetic construct
  misc_feature 1..2115: note = mRNA product Design h-5 comprising derived and/or modified sequence from HRSV(Memphis-37)__AIY60640.1__F-del_DSCav1 (opt5)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13168 - RNA, 2115 nt, synthetic construct
  misc_feature 1..2115: note = mRNA product Design h-5 comprising derived and/or modified sequence from HRSV(Memphis-37)__AIY60640.1__F-del_DSCav1 (opt6)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13169 - RNA, 2115 nt, synthetic construct
  misc_feature 1..2115: note = mRNA product Design h-5 comprising derived and/or modified sequence from HRSV(Memphis-37)__AIY60640.1__F-del_DSCav1 (opt11)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13170 - RNA, 2048 nt, synthetic construct
  misc_feature 1..2048: note = mRNA product Design i-1 comprising derived and/or modified sequence from HRSV(Memphis-37)__AIY60640.1__F-del_DSCav1 (opt1)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13171 - RNA, 2048 nt, synthetic construct
  misc_feature 1..2048: note = mRNA product Design i-1 comprising derived and/or modified sequence from HRSV(Memphis-37)__AIY60640.1__F-del_DSCav1 (opt1)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13172 - RNA, 2048 nt, synthetic construct
  misc_feature 1..2048: note = mRNA product Design i-1 comprising derived and/or modified sequence from HRSV(Memphis-37)__AIY60640.1__F-del_DSCav1 (opt2)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13173 - RNA, 2048 nt, synthetic construct
  misc_feature 1..2048: note = mRNA product Design i-1 comprising derived and/or modified sequence from HRSV(Memphis-37)__AIY60640.1__F-del_DSCav1 (opt3)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13174 - RNA, 2048 nt, synthetic construct
  misc_feature 1..2048: note = mRNA product Design i-1 comprising derived and/or modified sequence from HRSV(Memphis-37)__AIY60640.1__F-del_DSCav1 (opt4)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13175 - RNA, 2048 nt, synthetic construct
  misc_feature 1..2048: note = mRNA product Design i-1 comprising derived and/or modified sequence from HRSV(Memphis-37)__AIY60640.1__F-del_DSCav1 (opt5)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13176 - RNA, 2048 nt, synthetic construct
  misc_feature 1..2048: note = mRNA product Design i-1 comprising derived and/or modified sequence from HRSV(Memphis-37)__AIY60640.1__F-del_DSCav1 (opt6)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13177 - RNA, 2048 nt, synthetic construct
  misc_feature 1..2048: note = mRNA product Design i-1 comprising derived and/or modified sequence from HRSV(Memphis-37)__AIY60640.1__F-del_DSCav1 (opt11)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13178 - RNA, 2048 nt, synthetic construct
  misc_feature 1..2048: note = mRNA product Design i-2 comprising derived and/or modified sequence from HRSV(Memphis-37)__AIY60640.1__F-del_DSCav1 (opt1)
  source 1..2048: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13179 - RNA, 2048 nt, synthetic construct
  misc_feature 1..2048: note = mRNA product Design i-2 comprising derived and/or modified sequence from HRSV(Memphis-37)__AIY60640.1__F-del_DSCav1 (opt1)
  source 1..2048: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13180 - RNA, 2048 nt, synthetic construct
  misc_feature 1..2048: note = mRNA product Design i-2 comprising derived and/or modified sequence from HRSV(Memphis-37)__AIY60640.1__F-del_DSCav1 (opt2)
  source 1..2048: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13181 - RNA, 2048 nt, synthetic construct
  misc_feature 1..2048: note = mRNA product Design i-2 comprising derived and/or modified sequence from HRSV(Memphis-37)__AIY60640.1__F-del_DSCav1 (opt3)
  source 1..2048: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13182 - RNA, 2048 nt, synthetic construct
  misc_feature 1..2048: note = mRNA product Design i-2 comprising derived and/or modified sequence from HRSV(Memphis-37)__AIY60640.1__F-del_DSCav1 (opt4)
  source 1..2048: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13183 - RNA, 2048 nt, synthetic construct
  misc_feature 1..2048: note = mRNA product Design i-2 comprising derived and/or modified sequence from HRSV(Memphis-37)__AIY60640.1__F-del_DSCav1 (opt5)
  source 1..2048: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13184 - RNA, 2048 nt, synthetic construct
  misc_feature 1..2048: note = mRNA product Design i-2 comprising derived and/or modified sequence from HRSV(Memphis-37)__AIY60640.1__F-del_DSCav1 (opt6)
  source 1..2048: mol_type = other RNA
gggagaggcgctgcctacggaggtggcagccatctccttctcggcatcaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13185 - RNA, 2048 nt, synthetic construct
  misc_feature 1..2048: note = mRNA product Design i-2 comprising derived and/or modified sequence from HRSV(Memphis-37)__AIY60640.1__F-del_DSCav1 (opt11)
  source 1..2048: mol_type = other RNA
gggagaggcgctgcctacggaggtggcagccatctccttctcggcatcaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13186 - RNA, 2044 nt, synthetic construct
  misc_feature 1..2044: note = mRNA product Design i-2 comprising derived and/or modified sequence from HRSV(Memphis-37)__AIY60640.1__F-del_DSCav1 (opt1)
  source 1..2044: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13187 - RNA, 2044 nt, synthetic construct
  misc_feature 1..2044: note = mRNA product Design i-2 comprising derived and/or modified sequence from HRSV(Memphis-37)__AIY60640.1__F-del_DSCav1 (opt1)
  source 1..2044: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13188 - RNA, 2044 nt, synthetic construct
  misc_feature 1..2044: note = mRNA product Design i-2 comprising derived and/or modified sequence from HRSV(Memphis-37)__AIY60640.1__F-del_DSCav1 (opt2)
  source 1..2044: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13189 - RNA, 2044 nt, synthetic construct
  misc_feature 1..2044: note = mRNA product Design i-2 comprising derived and/or modified sequence from HRSV(Memphis-37)__AIY60640.1__F-del_DSCav1 (opt3)
  source 1..2044: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13190 - RNA, 2044 nt, synthetic construct
  misc_feature 1..2044: note = mRNA product Design i-2 comprising derived and/or modified sequence from HRSV(Memphis-37)__AIY60640.1__F-del_DSCav1 (opt4)
  source 1..2044: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13191 - RNA, 2044 nt, synthetic construct
  misc_feature 1..2044: note = mRNA product Design i-2 comprising derived and/or modified sequence from HRSV(Memphis-37)__AIY60640.1__F-del_DSCav1 (opt5)
  source 1..2044: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13192 - RNA, 2044 nt, synthetic construct
  misc_feature 1..2044: note = mRNA product Design i-2 comprising derived and/or modified sequence from HRSV(Memphis-37)__AIY60640.1__F-del_DSCav1 (opt6)
  source 1..2044: mol_type = other RNA
ggggcgctgcctacggaggtggcagccatctccttctcggcatcaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13193 - RNA, 2044 nt, synthetic construct
  misc_feature 1..2044: note = mRNA product Design i-2 comprising derived and/or modified sequence from HRSV(Memphis-37)__AIY60640.1__F-del_DSCav1 (opt11)
  source 1..2044: mol_type = other RNA
ggggcgctgcctacggaggtggcagccatctccttctcggcatcaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13194 - RNA, 1879 nt, synthetic construct
  misc_feature 1..1879: note = mRNA product Design i-3 comprising derived and/or modified sequence from HRSV(Memphis-37)__AIY60640.1__F-del_DSCav1 (opt1)
  source 1..1879: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13195 - RNA, 1879 nt, synthetic construct
  misc_feature 1..1879: note = mRNA product Design i-3 comprising derived and/or modified sequence from HRSV(Memphis-37)__AIY60640.1__F-del_DSCav1 (opt1)
  source 1..1879: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccaacaaccgggcccgccgggagctgccccgcttcatgaactacaccctcaacaacaccaagaacaacaacgtgacgctgtccaagaagcggaagcgccggttcctggggttcctcctgggcgtggggagcgcgatcgcctccggcatcgccgtctgcaaggtgctgcacctcgagggcgaggtgaacaagatcaagaacgccctgctgagcaccaacaaggccgtcgtgtccctcagcaacggggtgtccgtcctgaccttcaaggtgctggacctcaagaactacatcgacaagcagctgctgcccatcctcaacaagcagagctgctccatcagcaacatcgagaccgtgatcgagttccagcagaagaacaaccgcctgctggagatcacgcgggagttctccgtcaacgcgggcgtgaccacccccgtgagcacctacatgctcacgaacagcgagctgctgtccctcatcaacgacatgccgatcaccaacgaccagaagaagctgatgagcaacaacgtccagatcgtgcgccagcagtcctacagcatcatgtgcatcatcaaggaggaggtgctggcctacgtcgtgcagctccccctgtacggggtgatcgacaccccctgctggaagctgcacaccagccccctctgcacgaccaacaccaaggagggcagcaacatctgcctgacccggacggaccgcgggtggtactgcgacaacgccggctccgtcagcttcttcccgcaggccgagacctgcaaggtgcagtccaaccgggtcttctgcgacaccatgaacagcctgaccctcccctccgaggtgaacctgtgcaacatcgacatcttcaaccccaagtacgactgcaagatcatgacgagcaagaccgacgtgtccagctccgtcatcaccagcctgggcgccatcgtgtcctgctacgggaagaccaagtgcacggcgagcaacaagaaccgcggcatcatcaagaccttctccaacgggtgcgactacgtgagcaacaagggcgtcgacaccgtgagcgtgggcaacaccctctactacgtcaacaagcaggaggggaagtccctgtacgtgaagggcgagcccatcatcaacttctacgacccgctggtgttccccagcgacgagttcgacgcctccatcagccaggtcaacgagaagatcaaccagtccctcgccttcatccggaagtccgacgagctgctgcacaacgtgaacgtggggaagtccaccacgaacatcatgatcaccaccatcatcatcgtcatcatcgtgatcctgctcctgctgatcgccgtgggcctcttcctgtactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13196 - RNA, 1879 nt, synthetic construct
  misc_feature 1..1879: note = mRNA product Design i-3 comprising derived and/or modified sequence from HRSV(Memphis-37)__AIY60640.1__F-del_DSCav1 (opt2)
  source 1..1879: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccaacaaccgcgcccgccgcgagctcccccgcttcatgaactacaccctcaacaacaccaagaacaacaacgtcaccctctccaagaagcgcaagcgccgcttcctcggcttcctcctcggcgtcggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13197 - RNA, 1879 nt, synthetic construct
  misc_feature 1..1879: note = mRNA product Design i-3 comprising derived and/or modified sequence from HRSV(Memphis-37)__AIY60640.1__F-del_DSCav1 (opt3)
  source 1..1879: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctaacaatagggcacggcgcgagttgccacgattcatgaactacacactcaataacacgaagaataacaatgtgactctgagcaaaaagcgtaaaagaaggtttctgggtttcctcttaggcgtcgggtcagccatagctagtggaatcgccgtgtgtaaggttctgcaccttgaaggcgaggtgaacaagattaaaaatgcgttgctgtccaccaacaaggcagtcgtgtctctaagcaacggtgtatccgttctcacatttaaagtgctggaccttaagaattatatcgataaacaactgttgccgattctcaacaagcagtcatgcagtatcagcaatatagaaactgtcattgagttccagcagaaaaacaatcggctgttagagatcacccgcgaattttctgtgaacgccggggtgacaacccccgtctccacgtacatgctgactaattcagagctccttagcctgattaacgacatgcctatcacaaatgatcaaaagaagttgatgagtaacaatgttcagatcgtgagacagcagtcttattccattatgtgtataatcaaagaagaggtactagcttacgtggtccaactgccactctacggagtgattgacaccccctgctggaagctgcatactagccctctttgtacaaccaacacgaaagaaggctcgaatatctgcctgaccaggacagatcggggctggtattgtgacaacgccgggtctgtttccttctttccacaggcagagacttgcaaggtgcagtcaaatcgcgtcttctgtgataccatgaacagtttgacactccccagcgaggtgaacctgtgcaatatagacatttttaaccctaaatacgattgcaagatcatgacttccaagaccgacgtatctagctcagttatcacaagtttaggagctattgtgtcctgttatggtaaaaccaagtgcactgccagcaataaaaaccgaggcatcattaagacgttctctaatgggtgtgattacgtctcaaacaaaggagtggacacagtcagtgtgggcaataccctgtattacgttaacaagcaagaaggtaagagcctatatgtgaaaggggagccaataatcaatttttacgacccgctcgtattcccctccgatgagttcgacgcgtctatttcgcaggtcaacgaaaagatcaatcagagcctggcctttatcagaaaatccgatgaacttttgcacaacgtgaatgttggaaagtcaactaccaacattatgataacaaccatcattatcgtgattatcgtcatactgctcctgcttatcgcagtgggcctgttcttgtactgcaaagctaggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13198 - RNA, 1879 nt, synthetic construct
  misc_feature 1..1879: note = mRNA product Design i-3 comprising derived and/or modified sequence from HRSV(Memphis-37)__AIY60640.1__F-del_DSCav1 (opt4)
  source 1..1879: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccaacaacagagccagaagagagctgcccagattcatgaactacaccctgaacaacaccaagaacaacaacgtgaccctgagcaagaagagaaagagaagattcctgggcttcctgctgggcgtgggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13199 - RNA, 1879 nt, synthetic construct
  misc_feature 1..1879: note = mRNA product Design i-3 comprising derived and/or modified sequence from HRSV(Memphis-37)__AIY60640.1__F-del_DSCav1 (opt5)
  source 1..1879: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctaacaatcgggcccgcagagagctcccgcggttcatgaactacacactgaataacaccaagaataacaatgtcacacttagcaaaaagcgcaaaagacggtttctgggcttcctcctgggggtgggatccgcgattgccagcggcatcgctgtttgtaaggtgcttcacctggaaggggaggtcaacaagattaaaaatgccctcctgtctaccaacaaggctgtggtttccctgagcaacggagtgtctgtcctcacgtttaaagtgctggaccttaagaattatatcgataaacaactgctccccattctgaacaagcagtcctgcagcatctctaatattgaaacagtgatcgagttccagcagaaaaacaatcgccttctggagatcaccagagaattttccgtcaacgccggcgttacaacccctgtgagcacctacatgctcacaaattccgagctgctgtctctcattaacgacatgcccatcacgaatgatcaaaagaagctgatgagcaacaatgtgcagattgtccggcagcagtcctatagcatcatgtgtattatcaaagaagaggtgcttgcgtacgttgtgcaactgcctctctacggcgtcatcgacaccccctgctggaagctgcatacatctcctctttgtaccacaaacaccaaagaagggtccaatatttgcctgacgcgcacagatagaggatggtattgtgacaacgccggcagcgtgtctttctttccgcaggctgagacctgcaaggttcagagcaatcgggtgttctgtgataccatgaactccctcacactgccctctgaggtcaacctgtgcaatatcgacatttttaaccctaaatacgattgcaagatcatgaccagcaagacagacgtgtccagctctgtcattacgtccctcggggccatcgtgagctgttatggaaaaaccaagtgcacagcttctaataaaaaccgcggcatcattaagaccttctccaatgggtgtgattacgttagcaacaaaggagtggacacagtctccgtgggcaataccctgtattacgttaacaagcaagaaggcaagtctctttatgtgaaaggggagcccatcattaatttttacgaccctctggtcttccccagcgatgagttcgacgcctccatctctcaggtgaacgaaaagattaatcagagcctcgcctttatcagaaaatccgatgaactgctgcacaacgtgaatgttggaaagagcacgaccaacattatgatcacaaccatcattatcgtcattatcgtgattcttctcctgctgatcgctgtgggcctcttcctgtactgcaaagcgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13200 - RNA, 1879 nt, synthetic construct
  misc_feature 1..1879: note = mRNA product Design i-3 comprising derived and/or modified sequence from HRSV(Memphis-37)__AIY60640.1__F-del_DSCav1 (opt6)
  source 1..1879: mol_type = other RNA
gggagaaagcttaccatggaattaccaatccttaaaacaaacgcaataacaaccatcctcgcagcagtaactctctgcttcgcttcatctcaaaacatcacagaagaattttaccaaagcacatgctcagctgtatccaaaggttatctatcagccttgagaaccggatggtacacatcagtaataacaattgaactatcaaacattaaagaaaacaaatgcaacggcaccgacgcaaaagtaaaactaatcaaacaagaactagacaaatataaaaatgcagtaacagaattacaattattaatgcaatccacaccagctgcaaacaaccgagcccgaagagaactaccaagattcatgaactacacactaaacaacaccaaaaataacaacgtcaccctatctaaaaaacgtaaaagaagattcttaggattcctcttaggagtcggatccgcaatagcaagcggcatagccgtatgtaaagtcctacacttagaaggtgaagtgaataaaataaaaaacgccctattaagcactaacaaagcagtagtctccctatcaaacggagtttcagtactcacattcaaagtactcgacctcaaaaactacatcgacaaacaacttttaccaattctaaacaaacaatcatgctccatatctaatatcgaaaccgtcatcgaatttcaacaaaaaaacaatagactactagaaataactagagaattttcagtaaacgccggcgttacgacaccagtctctacatacatgttaaccaattcagaactcttatcattaatcaacgacatgccaataacaaacgaccaaaaaaaactaatgtccaataacgtacaaatagtcagacaacaatcatactcaattatgtgcataataaaagaagaagtactagcttacgtagtacaactccccctatacggcgtaatagacactccatgttggaaattacacacatcaccattatgtaccaccaatacaaaagaaggctcaaacatatgcctaacaagaacagatagaggatggtattgcgacaacgcaggctcagtttcctttttcccccaagcagaaacctgcaaagtacaatcaaatcgtgttttttgcgacaccatgaactcactcacattaccatcagaagtaaacctatgcaacatagacatattcaacccaaaatacgactgcaaaatcatgacatcaaaaacagacgtatcctcttcagtaattactagcttaggagcaatagtctcttgttatggaaaaacaaaatgcacagccagtaacaaaaaccgcggaataataaaaaccttctcaaacggttgcgattacgtctctaacaaaggagtcgacacagtatcagtaggcaatacattatactacgttaacaaacaagaaggaaaatctttatacgtcaaaggagaacccattataaacttttacgacccattagtcttcccttccgacgaatttgacgccagcatttcacaagtaaacgaaaaaataaaccaatcactcgcatttataagaaaatctgacgaattactccacaacgtaaacgtaggaaaatccacaacaaacataatgataacaaccataatcatcgtcataatagtcatacttctcctattaattgcagtaggcttattcctatactgtaaagcacgataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13201 - RNA, 1879 nt, synthetic construct
  misc_feature 1..1879: note = mRNA product Design i-3 comprising derived and/or modified sequence from HRSV(Memphis-37)__AIY60640.1__F-del_DSCav1 (opt11)
  source 1..1879: mol_type = other RNA
gggagaaagcttaccatggaactaccaatcctaaaaactaacgcaatcaccacaatcctcgccgccgtcaccctttgctttgcgtcctcccaaaacattactgaagagttctaccaatccacgtgctccgccgtctccaaaggttacctatccgcccttaggaccggctggtacaccagcgtcatcaccatcgaactttccaacatcaaagaaaacaaatgtaacggcaccgacgcaaaagtcaaacttattaaacaggaactcgacaaatataagaatgccgtcaccgaattacaactcctcatgcaatccacccccgccgccaacaaccgagcaaggcgcgaactccctcgattcatgaattacaccctcaacaataccaaaaacaacaacgtcaccctatccaagaaacgcaaaagacgcttcttgggcttcctcctcggcgtgggctccgcaatagcctccggtattgccgtgtgcaaagtcttacacctcgaaggcgaggtcaacaaaatcaaaaacgccctcctctccaccaacaaagccgtcgtcagcctatccaacggcgtttccgtcctcaccttcaaagtactcgacctcaaaaactacatcgacaaacaactcctacccatactaaacaaacaatcctgctccatttccaacatcgaaaccgtaatcgagttccaacagaaaaacaatcgcctcctagaaatcacacgtgaattttcagttaacgccggagtaacaactcctgtatctacctacatgctcaccaattccgaactcctcagcctcataaacgacatgccaataacaaacgaccaaaagaaactcatgtctaacaacgtacaaatcgtcagacaacaaagttactcaatcatgtgtatcatcaaagaggaagtcctagcatacgtggtccaactccccctctacggagtaatcgacaccccatgctggaaactacacaccagccccctctgtaccacaaacacgaaagaaggttccaacatctgcctgacccgaaccgaccgcggctggtactgcgataacgctggctccgtctcattcttcccccaagcagaaacctgcaaagtacaatccaaccgagtattctgcgacaccatgaactcactcaccctccccagcgaagtaaacctctgcaacatcgacatattcaacccaaaatacgactgcaaaattatgacctctaaaacagacgtatcctcctctgtaatcacatccctcggggccatcgtctcctgctacggcaaaaccaaatgcaccgcctccaacaaaaaccgcggaatcataaaaaccttctccaacggatgcgactacgtctcaaataaaggcgtcgacaccgtctccgtcggcaacacgctatactacgtcaacaaacaagaaggcaaatcactctacgtcaaaggtgagcccatcatcaatttctacgatcccctcgtcttcccaagcgacgagttcgacgccagcatatcccaagtaaacgagaaaatcaaccaaagcctggccttcatccgcaaatccgacgaactactacacaacgtaaacgtaggcaagtccactaccaacataatgatcaccacaatcatcatagtcataatcgttatactactcctgctcatcgccgtaggcctcttcctctattgcaaagcccgatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13202 - protein, 535 aa, synthetic construct
  REGION 1..535: note = derived and/or modified protein sequence (artificial) from HRSV(Memphis-37)__AIY60640.1__F_DSCav1_mut0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAAGSGSAIASGIAVCKVLHLEGEVNKIKNALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 13203 - RNA, 1608 nt, synthetic construct
  misc_feature 1..1608: note = derived and/or modified CDS sequence (opt1) from HRSV(Memphis-37)__AIY60640.1__F_DSCav1_mut0
  source 1..1608: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactga

SEQ ID NO: 13204 - RNA, 1608 nt, synthetic construct
  misc_feature 1..1608: note = derived and/or modified CDS sequence (opt1) from HRSV(Memphis-37)__AIY60640.1__F_DSCav1_mut0
  source 1..1608: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactga

SEQ ID NO: 13205 - RNA, 1608 nt, synthetic construct
  misc_feature 1..1608: note = derived and/or modified CDS sequence (opt2) from HRSV(Memphis-37)__AIY60640.1__F_DSCav1_mut0
  source 1..1608: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactga

SEQ ID NO: 13206 - RNA, 1608 nt, synthetic construct
  misc_feature 1..1608: note = derived and/or modified CDS sequence (opt3) from HRSV(Memphis-37)__AIY60640.1__F_DSCav1_mut0
  source 1..1608: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattga

SEQ ID NO: 13207 - RNA, 1608 nt, synthetic construct
  misc_feature 1..1608: note = derived and/or modified CDS sequence (opt4) from HRSV(Memphis-37)__AIY60640.1__F_DSCav1_mut0
  source 1..1608: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactga

SEQ ID NO: 13208 - RNA, 1608 nt, synthetic construct
  misc_feature 1..1608: note = derived and/or modified CDS sequence (opt5) from HRSV(Memphis-37)__AIY60640.1__F_DSCav1_mut0
  source 1..1608: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattga

SEQ ID NO: 13209 - RNA, 1608 nt, synthetic construct
  misc_feature 1..1608: note = derived and/or modified CDS sequence (opt6) from HRSV(Memphis-37)__AIY60640.1__F_DSCav1_mut0
  source 1..1608: mol_type = other RNA
atggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaa

SEQ ID NO: 13210 - RNA, 1608 nt, synthetic construct
  misc_feature 1..1608: note = derived and/or modified CDS sequence (opt11) from HRSV(Memphis-37)__AIY60640.1__F_DSCav1_mut0
  source 1..1608: mol_type = other RNA
atggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaa

SEQ ID NO: 13211 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut0 (opt1)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13212 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut0 (opt1)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13213 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut0 (opt2)
  source 1..1884: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13214 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut0 (opt3)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13215 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut0 (opt4)
  source 1..1884: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13216 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut0 (opt5)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13217 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut0 (opt6)
  source 1..1884: mol_type = other RNA
gggagagtcccgcagtcggcgtccagcggctctgcttgttcgtgtgtgtgtcgttgcaggccttattcaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13218 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut0 (opt11)
  source 1..1884: mol_type = other RNA
gggagagtcccgcagtcggcgtccagcggctctgcttgttcgtgtgtgtgtcgttgcaggccttattcaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13219 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut0 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13220 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut0 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13221 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut0 (opt2)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13222 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut0 (opt3)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13223 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut0 (opt4)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13224 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut0 (opt5)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13225 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut0 (opt6)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13226 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut0 (opt11)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13227 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut0 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13228 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut0 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13229 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut0 (opt2)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13230 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut0 (opt3)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13231 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut0 (opt4)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13232 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut0 (opt5)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13233 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut0 (opt6)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13234 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut0 (opt11)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13235 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut0 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13236 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut0 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13237 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut0 (opt2)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13238 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut0 (opt3)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13239 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut0 (opt4)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13240 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut0 (opt5)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13241 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut0 (opt6)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13242 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut0 (opt11)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13243 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut0 (opt1)
  source 1..1876: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13244 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut0 (opt1)
  source 1..1876: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13245 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut0 (opt2)
  source 1..1876: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13246 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut0 (opt3)
  source 1..1876: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13247 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut0 (opt4)
  source 1..1876: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13248 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut0 (opt5)
  source 1..1876: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13249 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut0 (opt6)
  source 1..1876: mol_type = other RNA
gggagactttcccattctgtagcagaatttggtgttgcctgtggtcttggtcccgcggagaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13250 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut0 (opt11)
  source 1..1876: mol_type = other RNA
gggagactttcccattctgtagcagaatttggtgttgcctgtggtcttggtcccgcggagaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13251 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut0 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13252 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut0 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13253 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut0 (opt2)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13254 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut0 (opt3)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13255 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut0 (opt4)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13256 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut0 (opt5)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13257 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut0 (opt6)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13258 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut0 (opt11)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13259 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut0 (opt1)
  source 1..1877: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13260 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut0 (opt1)
  source 1..1877: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13261 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut0 (opt2)
  source 1..1877: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13262 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut0 (opt3)
  source 1..1877: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13263 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut0 (opt4)
  source 1..1877: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13264 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut0 (opt5)
  source 1..1877: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13265 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut0 (opt6)
  source 1..1877: mol_type = other RNA
gggagagcctctgctggagtccggggagtggcgttggctgctagagcgaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13266 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut0 (opt11)
  source 1..1877: mol_type = other RNA
gggagagcctctgctggagtccggggagtggcgttggctgctagagcgaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13267 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut0 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13268 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut0 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13269 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut0 (opt2)
  source 1..1897: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13270 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut0 (opt3)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13271 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut0 (opt4)
  source 1..1897: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13272 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut0 (opt5)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13273 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut0 (opt6)
  source 1..1897: mol_type = other RNA
gggagagtcccgcagtcggcgtccagcggctctgcttgttcgtgtgtgtgtcgttgcaggccttattcaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13274 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut0 (opt11)
  source 1..1897: mol_type = other RNA
gggagagtcccgcagtcggcgtccagcggctctgcttgttcgtgtgtgtgtcgttgcaggccttattcaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13275 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut0 (opt1)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13276 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut0 (opt1)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13277 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut0 (opt2)
  source 1..1948: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13278 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut0 (opt3)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13279 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut0 (opt4)
  source 1..1948: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13280 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut0 (opt5)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13281 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut0 (opt6)
  source 1..1948: mol_type = other RNA
gggagagtcccgcagtcggcgtccagcggctctgcttgttcgtgtgtgtgtcgttgcaggccttattcaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13282 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut0 (opt11)
  source 1..1948: mol_type = other RNA
gggagagtcccgcagtcggcgtccagcggctctgcttgttcgtgtgtgtgtcgttgcaggccttattcaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13283 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut0 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13284 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut0 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13285 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut0 (opt2)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13286 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut0 (opt3)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13287 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut0 (opt4)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13288 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut0 (opt5)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13289 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut0 (opt6)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13290 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut0 (opt11)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13291 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut0 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13292 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut0 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13293 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut0 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13294 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut0 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13295 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut0 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13296 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut0 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13297 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut0 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13298 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut0 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13299 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut0 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13300 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut0 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13301 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut0 (opt2)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13302 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut0 (opt3)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13303 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut0 (opt4)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13304 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut0 (opt5)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13305 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut0 (opt6)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13306 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut0 (opt11)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13307 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut0 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13308 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut0 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13309 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut0 (opt2)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13310 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut0 (opt3)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13311 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut0 (opt4)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13312 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut0 (opt5)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13313 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut0 (opt6)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13314 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut0 (opt11)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13315 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut0 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13316 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut0 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13317 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut0 (opt2)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13318 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut0 (opt3)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13319 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut0 (opt4)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13320 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut0 (opt5)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13321 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut0 (opt6)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13322 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut0 (opt11)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13323 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut0 (opt1)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13324 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut0 (opt1)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13325 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut0 (opt2)
  source 1..1897: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13326 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut0 (opt3)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13327 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut0 (opt4)
  source 1..1897: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13328 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut0 (opt5)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13329 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut0 (opt6)
  source 1..1897: mol_type = other RNA
gggagagcggctcggccattttgtcccagtcagtccggaggctgcggctgcagaagtaccgcctgcggagtaactgcaaagaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13330 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut0 (opt11)
  source 1..1897: mol_type = other RNA
gggagagcggctcggccattttgtcccagtcagtccggaggctgcggctgcagaagtaccgcctgcggagtaactgcaaagaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13331 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut0 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13332 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut0 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13333 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut0 (opt2)
  source 1..1906: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13334 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut0 (opt3)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13335 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut0 (opt4)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13336 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut0 (opt5)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13337 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut0 (opt6)
  source 1..1906: mol_type = other RNA
gggagacccgtgacccggaagttgtacggctacgcgactttccctcccacaaaccctcgcgcccttcctttcctacttgggcccggcagaaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13338 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut0 (opt11)
  source 1..1906: mol_type = other RNA
gggagacccgtgacccggaagttgtacggctacgcgactttccctcccacaaaccctcgcgcccttcctttcctacttgggcccggcagaaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13339 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut0 (opt1)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13340 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut0 (opt1)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13341 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut0 (opt2)
  source 1..1961: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13342 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut0 (opt3)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13343 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut0 (opt4)
  source 1..1961: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13344 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut0 (opt5)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13345 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut0 (opt6)
  source 1..1961: mol_type = other RNA
gggagagcggctcggccattttgtcccagtcagtccggaggctgcggctgcagaagtaccgcctgcggagtaactgcaaagaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13346 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut0 (opt11)
  source 1..1961: mol_type = other RNA
gggagagcggctcggccattttgtcccagtcagtccggaggctgcggctgcagaagtaccgcctgcggagtaactgcaaagaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13347 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut0 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13348 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut0 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13349 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut0 (opt2)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13350 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut0 (opt3)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13351 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut0 (opt4)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13352 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut0 (opt5)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13353 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut0 (opt6)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13354 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut0 (opt11)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13355 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut0 (opt1)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13356 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut0 (opt1)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13357 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut0 (opt2)
  source 1..1960: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13358 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut0 (opt3)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13359 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut0 (opt4)
  source 1..1960: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13360 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut0 (opt5)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13361 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut0 (opt6)
  source 1..1960: mol_type = other RNA
gggagagtcccgcagtcggcgtccagcggctctgcttgttcgtgtgtgtgtcgttgcaggccttattcaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13362 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut0 (opt11)
  source 1..1960: mol_type = other RNA
gggagagtcccgcagtcggcgtccagcggctctgcttgttcgtgtgtgtgtcgttgcaggccttattcaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13363 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut0 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13364 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut0 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13365 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut0 (opt2)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13366 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut0 (opt3)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13367 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut0 (opt4)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13368 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut0 (opt5)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13369 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut0 (opt6)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13370 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut0 (opt11)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13371 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut0 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13372 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut0 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13373 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut0 (opt2)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13374 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut0 (opt3)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13375 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut0 (opt4)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13376 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut0 (opt5)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13377 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut0 (opt6)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13378 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut0 (opt11)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13379 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut0 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13380 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut0 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13381 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut0 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13382 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut0 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13383 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut0 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13384 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut0 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13385 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut0 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13386 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut0 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13387 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut0 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13388 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut0 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13389 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut0 (opt2)
  source 1..1889: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13390 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut0 (opt3)
  source 1..1889: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13391 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut0 (opt4)
  source 1..1889: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13392 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut0 (opt5)
  source 1..1889: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13393 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut0 (opt6)
  source 1..1889: mol_type = other RNA
gggagactttcccattctgtagcagaatttggtgttgcctgtggtcttggtcccgcggagaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13394 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut0 (opt11)
  source 1..1889: mol_type = other RNA
gggagactttcccattctgtagcagaatttggtgttgcctgtggtcttggtcccgcggagaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13395 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut0 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13396 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut0 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13397 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut0 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13398 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut0 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13399 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut0 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13400 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut0 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13401 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut0 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13402 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut0 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13403 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut0 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13404 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut0 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13405 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut0 (opt2)
  source 1..1910: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13406 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut0 (opt3)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13407 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut0 (opt4)
  source 1..1910: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13408 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut0 (opt5)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13409 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut0 (opt6)
  source 1..1910: mol_type = other RNA
gggagagcggctcggccattttgtcccagtcagtccggaggctgcggctgcagaagtaccgcctgcggagtaactgcaaagaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13410 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut0 (opt11)
  source 1..1910: mol_type = other RNA
gggagagcggctcggccattttgtcccagtcagtccggaggctgcggctgcagaagtaccgcctgcggagtaactgcaaagaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13411 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut0 (opt1)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13412 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut0 (opt1)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13413 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut0 (opt2)
  source 1..1977: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13414 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut0 (opt3)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13415 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut0 (opt4)
  source 1..1977: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13416 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut0 (opt5)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13417 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut0 (opt6)
  source 1..1977: mol_type = other RNA
gggagagcggctcggccattttgtcccagtcagtccggaggctgcggctgcagaagtaccgcctgcggagtaactgcaaagaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13418 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut0 (opt11)
  source 1..1977: mol_type = other RNA
gggagagcggctcggccattttgtcccagtcagtccggaggctgcggctgcagaagtaccgcctgcggagtaactgcaaagaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13419 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut0 (opt1)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13420 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut0 (opt1)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13421 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut0 (opt2)
  source 1..2193: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13422 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut0 (opt3)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13423 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut0 (opt4)
  source 1..2193: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13424 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut0 (opt5)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13425 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut0 (opt6)
  source 1..2193: mol_type = other RNA
gggagagcggctcggccattttgtcccagtcagtccggaggctgcggctgcagaagtaccgcctgcggagtaactgcaaagaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13426 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut0 (opt11)
  source 1..2193: mol_type = other RNA
gggagagcggctcggccattttgtcccagtcagtccggaggctgcggctgcagaagtaccgcctgcggagtaactgcaaagaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13427 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut0 (opt1)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13428 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut0 (opt1)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13429 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut0 (opt2)
  source 1..1973: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13430 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut0 (opt3)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13431 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut0 (opt4)
  source 1..1973: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13432 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut0 (opt5)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13433 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut0 (opt6)
  source 1..1973: mol_type = other RNA
gggagagcggctcggccattttgtcccagtcagtccggaggctgcggctgcagaagtaccgcctgcggagtaactgcaaagaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13434 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut0 (opt11)
  source 1..1973: mol_type = other RNA
gggagagcggctcggccattttgtcccagtcagtccggaggctgcggctgcagaagtaccgcctgcggagtaactgcaaagaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13435 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut0 (opt1)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13436 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut0 (opt1)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13437 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut0 (opt2)
  source 1..1964: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13438 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut0 (opt3)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13439 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut0 (opt4)
  source 1..1964: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13440 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut0 (opt5)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13441 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut0 (opt6)
  source 1..1964: mol_type = other RNA
gggagagtcccgcagtcggcgtccagcggctctgcttgttcgtgtgtgtgtcgttgcaggccttattcaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13442 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut0 (opt11)
  source 1..1964: mol_type = other RNA
gggagagtcccgcagtcggcgtccagcggctctgcttgttcgtgtgtgtgtcgttgcaggccttattcaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13443 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut0 (opt1)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13444 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut0 (opt1)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13445 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut0 (opt2)
  source 1..2180: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13446 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut0 (opt3)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13447 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut0 (opt4)
  source 1..2180: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13448 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut0 (opt5)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13449 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut0 (opt6)
  source 1..2180: mol_type = other RNA
gggagagtcccgcagtcggcgtccagcggctctgcttgttcgtgtgtgtgtcgttgcaggccttattcaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13450 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut0 (opt11)
  source 1..2180: mol_type = other RNA
gggagagtcccgcagtcggcgtccagcggctctgcttgttcgtgtgtgtgtcgttgcaggccttattcaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13451 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut0 (opt1)
  source 1..1956: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13452 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut0 (opt1)
  source 1..1956: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13453 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut0 (opt2)
  source 1..1956: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13454 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut0 (opt3)
  source 1..1956: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13455 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut0 (opt4)
  source 1..1956: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13456 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut0 (opt5)
  source 1..1956: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13457 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut0 (opt6)
  source 1..1956: mol_type = other RNA
gggagactttcccattctgtagcagaatttggtgttgcctgtggtcttggtcccgcggagaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13458 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut0 (opt11)
  source 1..1956: mol_type = other RNA
gggagactttcccattctgtagcagaatttggtgttgcctgtggtcttggtcccgcggagaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13459 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut0 (opt1)
  source 1..1952: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13460 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut0 (opt1)
  source 1..1952: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13461 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut0 (opt2)
  source 1..1952: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13462 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut0 (opt3)
  source 1..1952: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13463 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut0 (opt4)
  source 1..1952: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13464 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut0 (opt5)
  source 1..1952: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13465 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut0 (opt6)
  source 1..1952: mol_type = other RNA
gggagactttcccattctgtagcagaatttggtgttgcctgtggtcttggtcccgcggagaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13466 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut0 (opt11)
  source 1..1952: mol_type = other RNA
gggagactttcccattctgtagcagaatttggtgttgcctgtggtcttggtcccgcggagaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13467 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut0 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13468 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut0 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13469 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut0 (opt2)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13470 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut0 (opt3)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13471 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut0 (opt4)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13472 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut0 (opt5)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13473 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut0 (opt6)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13474 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut0 (opt11)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13475 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut0 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13476 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut0 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13477 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut0 (opt2)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13478 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut0 (opt3)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13479 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut0 (opt4)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13480 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut0 (opt5)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13481 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut0 (opt6)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13482 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut0 (opt11)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13483 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut0 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13484 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut0 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13485 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut0 (opt2)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13486 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut0 (opt3)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13487 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut0 (opt4)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13488 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut0 (opt5)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13489 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut0 (opt6)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13490 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut0 (opt11)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13491 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut0 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13492 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut0 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13493 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut0 (opt2)
  source 1..1970: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13494 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut0 (opt3)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13495 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut0 (opt4)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13496 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut0 (opt5)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13497 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut0 (opt6)
  source 1..1970: mol_type = other RNA
gggagacccgtgacccggaagttgtacggctacgcgactttccctcccacaaaccctcgcgcccttcctttcctacttgggcccggcagaaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13498 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut0 (opt11)
  source 1..1970: mol_type = other RNA
gggagacccgtgacccggaagttgtacggctacgcgactttccctcccacaaaccctcgcgcccttcctttcctacttgggcccggcagaaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13499 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut0 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13500 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut0 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13501 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut0 (opt2)
  source 1..1986: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13502 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut0 (opt3)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13503 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut0 (opt4)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13504 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut0 (opt5)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13505 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut0 (opt6)
  source 1..1986: mol_type = other RNA
gggagacccgtgacccggaagttgtacggctacgcgactttccctcccacaaaccctcgcgcccttcctttcctacttgggcccggcagaaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13506 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut0 (opt11)
  source 1..1986: mol_type = other RNA
gggagacccgtgacccggaagttgtacggctacgcgactttccctcccacaaaccctcgcgcccttcctttcctacttgggcccggcagaaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13507 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut0 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13508 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut0 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13509 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut0 (opt2)
  source 1..2202: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13510 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut0 (opt3)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13511 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut0 (opt4)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13512 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut0 (opt5)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13513 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut0 (opt6)
  source 1..2202: mol_type = other RNA
gggagacccgtgacccggaagttgtacggctacgcgactttccctcccacaaaccctcgcgcccttcctttcctacttgggcccggcagaaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13514 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut0 (opt11)
  source 1..2202: mol_type = other RNA
gggagacccgtgacccggaagttgtacggctacgcgactttccctcccacaaaccctcgcgcccttcctttcctacttgggcccggcagaaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13515 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut0 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13516 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut0 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13517 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut0 (opt2)
  source 1..1982: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13518 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut0 (opt3)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13519 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut0 (opt4)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13520 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut0 (opt5)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13521 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut0 (opt6)
  source 1..1982: mol_type = other RNA
gggagacccgtgacccggaagttgtacggctacgcgactttccctcccacaaaccctcgcgcccttcctttcctacttgggcccggcagaaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13522 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut0 (opt11)
  source 1..1982: mol_type = other RNA
gggagacccgtgacccggaagttgtacggctacgcgactttccctcccacaaaccctcgcgcccttcctttcctacttgggcccggcagaaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13523 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut0 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13524 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut0 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13525 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut0 (opt2)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13526 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut0 (opt3)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13527 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut0 (opt4)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13528 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut0 (opt5)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13529 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut0 (opt6)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13530 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut0 (opt11)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13531 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut0 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13532 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut0 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13533 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut0 (opt2)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13534 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut0 (opt3)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13535 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut0 (opt4)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13536 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut0 (opt5)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13537 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut0 (opt6)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13538 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut0 (opt11)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13539 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut0 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13540 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut0 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13541 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut0 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13542 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut0 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13543 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut0 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13544 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut0 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13545 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut0 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13546 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut0 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13547 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut0 (opt1)
  source 1..1994: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13548 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut0 (opt1)
  source 1..1994: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13549 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut0 (opt2)
  source 1..1994: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13550 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut0 (opt3)
  source 1..1994: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13551 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut0 (opt4)
  source 1..1994: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13552 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut0 (opt5)
  source 1..1994: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13553 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut0 (opt6)
  source 1..1994: mol_type = other RNA
gggagaggcgctgcctacggaggtggcagccatctccttctcggcatcaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13554 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut0 (opt11)
  source 1..1994: mol_type = other RNA
gggagaggcgctgcctacggaggtggcagccatctccttctcggcatcaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13555 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut0 (opt1)
  source 1..1990: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13556 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut0 (opt1)
  source 1..1990: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13557 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut0 (opt2)
  source 1..1990: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13558 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut0 (opt3)
  source 1..1990: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13559 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut0 (opt4)
  source 1..1990: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13560 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut0 (opt5)
  source 1..1990: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13561 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut0 (opt6)
  source 1..1990: mol_type = other RNA
ggggcgctgcctacggaggtggcagccatctccttctcggcatcaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13562 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut0 (opt11)
  source 1..1990: mol_type = other RNA
ggggcgctgcctacggaggtggcagccatctccttctcggcatcaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13563 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut0 (opt1)
  source 1..1825: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13564 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut0 (opt1)
  source 1..1825: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13565 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut0 (opt2)
  source 1..1825: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13566 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut0 (opt3)
  source 1..1825: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgcagtacccccgtcacactgtctaaggaccagctcagcggcattaataacatcgctttctccaattgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13567 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut0 (opt4)
  source 1..1825: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13568 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut0 (opt5)
  source 1..1825: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatctacccccgtgacactttccaaggaccagctcagcggcatcaataacattgcgttctctaattgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13569 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut0 (opt6)
  source 1..1825: mol_type = other RNA
gggagaaagcttaccatggaattaccaatcttaaaaacaaacgccataacaaccatcctcgcagcagtaaccctatgctttgcatcctcacaaaacataactgaagaattttaccaatcaacatgctcagcagtatcaaaaggatatctatcagccctcagaacaggatggtacacatcagtcattacaatcgaactttcaaacataaaagaaaataaatgtaacggcacagatgccaaagtaaaattaattaaacaagaacttgacaaatacaaaaatgccgtaacagaactacaactactaatgcaaagtactcctgctgcaggaagcggatctgcaatagcatcaggtatagcagtatgtaaagttctacacctagaaggcgaagtaaacaaaattaaaaacgcactactctcaacaaataaagcagttgtctccctatcaaacggagtatcagtattaactttcaaagtactagacctcaaaaactatatagacaaacaactattaccaatactaaacaaacaaagctgctctatctccaacatcgaaacagtaatagaatttcaacaaaaaaataatagactacttgaaataaccagagaattttcagtaaacgccggagtaacaacaccagtatcaacttacatgctaacaaactccgaactactatcattaataaacgacatgcccataacaaacgaccaaaaaaaattaatgtcaaacaacgtccaaatcgtacgacaacaatcctattccataatgtgtataataaaagaagaagtactagcatacgtagtacaattaccattatatggagtaatagataccccttgctggaaactacacacatcacccctatgcactacaaatacgaaagaaggttcaaatatatgcttaactagaaccgatagaggttggtattgtgacaacgctggatcagtatcatttttcccacaagcagaaacatgcaaagtacaatcaaacagagtattttgcgacactatgaactcaagaactttaccatccgaagttaatctatgtaacatagatatatttaacccaaaatacgactgcaaaataatgacatcaaaaacagatgtatcatcatcagttataacctccctcggagcaatagtatcatgctatggaaaaacaaaatgcacagcatcaaacaaaaatcgtggaattataaaaacattctcaaacggctgtgactacgtcagcaataaaggagtagacacagtctcagtaggaaacactttatactatgttaacaaacaagaaggaaaatcactctacgtcaaaggcgaaccaataataaatttctatgacccactcgtattcccatccgacgaatttgacgcatcaatatcacaagtaaatgaaaaaataaaccaaagcctagcatttatacgaaaatcagacgaactactacacaacgtaaacgtaggtaaaagcacaaccaatataatgataacaacaataatcatagtaataatcgtaatattactattactaatagctgtaggattgttcctatactgcaaagcaagatcaacaccagtaaccttatctaaggaccaactatcaggaatcaataacattgccttctcaaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13570 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut0 (opt11)
  source 1..1825: mol_type = other RNA
gggagaaagcttaccatggaactacctatccttaaaaccaacgcaatcaccaccatccttgccgcagtcacactctgcttcgcatcctcacagaacatcaccgaagagttctatcaatcaacctgctccgccgtatccaaaggatacctctcagccctccgcaccggctggtatacctcagtcataacaatcgaattatcaaatatcaaggagaacaaatgcaacggcaccgacgccaaagtcaaactcataaaacaagaactagacaaatacaaaaacgccgtgacagaactccaactcctcatgcagtccacccccgcagccggatccggctcagcaatcgcctcgggcattgcagtatgcaaagtcctccacctcgaaggcgaagtcaacaaaatcaaaaacgccctcctctccaccaacaaagccgtcgtctccctctccaacggcgtatctgtcctcactttcaaggtcctcgacctcaaaaactacatcgacaagcaactacttccaatcctcaacaagcaatcctgctcaatctcaaacatcgaaaccgtaatagagttccaacaaaagaacaaccgcctcctcgaaatcacccgcgagttctccgttaacgccggtgtcactaccccagtcagcacctacatgctcaccaactccgaactcctttctctgatcaacgacatgccaatcaccaacgatcaaaagaaattaatgtccaacaacgtccagatcgtccgccaacaaagctacagcatcatgtgcatcataaaagaagaagtacttgcgtacgtagttcaactacccctttacggcgtaatcgacaccccatgctggaaactccacacctccccactatgcaccaccaacaccaaagaaggatccaacatctgcctaacccgcaccgaccgcggctggtactgcgacaacgctgggagcgtctcattcttcccacaagcagaaacctgcaaagtccaatcgaaccgcgtattctgcgacaccatgaactccagaaccctaccaagcgaagtcaatctttgcaacatcgacatatttaaccccaaatacgactgcaaaatcatgacatcaaagaccgacgtctcatcttcagtcattacctcactcggcgcaattgtcagctgctacggaaagaccaaatgtaccgcctccaataaaaaccgtggaatcataaaaacctttagcaacggctgcgactacgtctccaacaaaggagtcgacaccgtctccgtcggcaacaccctctactacgtcaacaaacaagaaggaaaatccctctacgtgaaaggcgaacccataataaacttctacgaccccctagtcttcccctctgacgagttcgacgcctccatctcccaagtcaacgaaaagataaatcaatcactagccttcatacgcaaatctgacgaacttctccacaacgtcaacgtcggcaaatccaccaccaacataatgatcacaacgataataatcgtgatcatagtaatcctacttctcctcatcgcagtaggtctattcctatactgcaaagcccgcagcacccccgtcaccctatcaaaagaccaactctccggcatcaacaacatcgccttctcaaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13571 - protein, 514 aa, synthetic construct
  REGION 1..514: note = derived and/or modified protein sequence (artificial) from HRSV(Memphis-37)__AIY60640.1__F-del_DSCav1_mut0
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAAGSGSAIASGIAVCKVLHLEGEVNKIKNALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 13572 - RNA, 1545 nt, synthetic construct
  misc_feature 1..1545: note = derived and/or modified CDS sequence (opt1) from HRSV(Memphis-37)__AIY60640.1__F-del_DSCav1_mut0
  source 1..1545: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctga

SEQ ID NO: 13573 - RNA, 1545 nt, synthetic construct
  misc_feature 1..1545: note = derived and/or modified CDS sequence (opt1) from HRSV(Memphis-37)__AIY60640.1__F-del_DSCav1_mut0
  source 1..1545: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtga

SEQ ID NO: 13574 - RNA, 1545 nt, synthetic construct
  misc_feature 1..1545: note = derived and/or modified CDS sequence (opt2) from HRSV(Memphis-37)__AIY60640.1__F-del_DSCav1_mut0
  source 1..1545: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctga

SEQ ID NO: 13575 - RNA, 1545 nt, synthetic construct
  misc_feature 1..1545: note = derived and/or modified CDS sequence (opt3) from HRSV(Memphis-37)__AIY60640.1__F-del_DSCav1_mut0
  source 1..1545: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctga

SEQ ID NO: 13576 - RNA, 1545 nt, synthetic construct
  misc_feature 1..1545: note = derived and/or modified CDS sequence (opt4) from HRSV(Memphis-37)__AIY60640.1__F-del_DSCav1_mut0
  source 1..1545: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatga

SEQ ID NO: 13577 - RNA, 1545 nt, synthetic construct
  misc_feature 1..1545: note = derived and/or modified CDS sequence (opt5) from HRSV(Memphis-37)__AIY60640.1__F-del_DSCav1_mut0
  source 1..1545: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatga

SEQ ID NO: 13578 - RNA, 1545 nt, synthetic construct
  misc_feature 1..1545: note = derived and/or modified CDS sequence (opt6) from HRSV(Memphis-37)__AIY60640.1__F-del_DSCav1_mut0
  source 1..1545: mol_type = other RNA
atggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatga

SEQ ID NO: 13579 - RNA, 1545 nt, synthetic construct
  misc_feature 1..1545: note = derived and/or modified CDS sequence (opt11) from HRSV(Memphis-37)__AIY60640.1__F-del_DSCav1_mut0
  source 1..1545: mol_type = other RNA
atggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctag

SEQ ID NO: 13580 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut0 (opt1)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13581 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut0 (opt1)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13582 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut0 (opt2)
  source 1..1821: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13583 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut0 (opt3)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13584 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut0 (opt4)
  source 1..1821: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13585 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut0 (opt5)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13586 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut0 (opt6)
  source 1..1821: mol_type = other RNA
gggagagtcccgcagtcggcgtccagcggctctgcttgttcgtgtgtgtgtcgttgcaggccttattcaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13587 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut0 (opt11)
  source 1..1821: mol_type = other RNA
gggagagtcccgcagtcggcgtccagcggctctgcttgttcgtgtgtgtgtcgttgcaggccttattcaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13588 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut0 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13589 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut0 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13590 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut0 (opt2)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13591 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut0 (opt3)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13592 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut0 (opt4)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13593 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut0 (opt5)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13594 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut0 (opt6)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13595 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut0 (opt11)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13596 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut0 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13597 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut0 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13598 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut0 (opt2)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13599 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut0 (opt3)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13600 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut0 (opt4)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13601 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut0 (opt5)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13602 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut0 (opt6)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13603 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut0 (opt11)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13604 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut0 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13605 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut0 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13606 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut0 (opt2)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13607 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut0 (opt3)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13608 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut0 (opt4)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13609 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut0 (opt5)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13610 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut0 (opt6)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13611 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut0 (opt11)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13612 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut0 (opt1)
  source 1..1813: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13613 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut0 (opt1)
  source 1..1813: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13614 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut0 (opt2)
  source 1..1813: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13615 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut0 (opt3)
  source 1..1813: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13616 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut0 (opt4)
  source 1..1813: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13617 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut0 (opt5)
  source 1..1813: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13618 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut0 (opt6)
  source 1..1813: mol_type = other RNA
gggagactttcccattctgtagcagaatttggtgttgcctgtggtcttggtcccgcggagaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13619 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut0 (opt11)
  source 1..1813: mol_type = other RNA
gggagactttcccattctgtagcagaatttggtgttgcctgtggtcttggtcccgcggagaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13620 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut0 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13621 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut0 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13622 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut0 (opt2)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13623 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut0 (opt3)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13624 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut0 (opt4)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13625 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut0 (opt5)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13626 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut0 (opt6)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13627 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut0 (opt11)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13628 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut0 (opt1)
  source 1..1814: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13629 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut0 (opt1)
  source 1..1814: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13630 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut0 (opt2)
  source 1..1814: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13631 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut0 (opt3)
  source 1..1814: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13632 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut0 (opt4)
  source 1..1814: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13633 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut0 (opt5)
  source 1..1814: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13634 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut0 (opt6)
  source 1..1814: mol_type = other RNA
gggagagcctctgctggagtccggggagtggcgttggctgctagagcgaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13635 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut0 (opt11)
  source 1..1814: mol_type = other RNA
gggagagcctctgctggagtccggggagtggcgttggctgctagagcgaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13636 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut0 (opt1)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13637 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut0 (opt1)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13638 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut0 (opt2)
  source 1..1834: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13639 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut0 (opt3)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13640 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut0 (opt4)
  source 1..1834: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13641 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut0 (opt5)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13642 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut0 (opt6)
  source 1..1834: mol_type = other RNA
gggagagtcccgcagtcggcgtccagcggctctgcttgttcgtgtgtgtgtcgttgcaggccttattcaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13643 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut0 (opt11)
  source 1..1834: mol_type = other RNA
gggagagtcccgcagtcggcgtccagcggctctgcttgttcgtgtgtgtgtcgttgcaggccttattcaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13644 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut0 (opt1)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13645 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut0 (opt1)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13646 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut0 (opt2)
  source 1..1885: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13647 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut0 (opt3)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13648 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut0 (opt4)
  source 1..1885: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13649 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut0 (opt5)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13650 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut0 (opt6)
  source 1..1885: mol_type = other RNA
gggagagtcccgcagtcggcgtccagcggctctgcttgttcgtgtgtgtgtcgttgcaggccttattcaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13651 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut0 (opt11)
  source 1..1885: mol_type = other RNA
gggagagtcccgcagtcggcgtccagcggctctgcttgttcgtgtgtgtgtcgttgcaggccttattcaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13652 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut0 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13653 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut0 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13654 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut0 (opt2)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13655 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut0 (opt3)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13656 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut0 (opt4)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13657 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut0 (opt5)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13658 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut0 (opt6)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13659 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut0 (opt11)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13660 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut0 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13661 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut0 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13662 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut0 (opt2)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13663 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut0 (opt3)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13664 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut0 (opt4)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13665 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut0 (opt5)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13666 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut0 (opt6)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13667 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut0 (opt11)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13668 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut0 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13669 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut0 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13670 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut0 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13671 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut0 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13672 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut0 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13673 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut0 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13674 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut0 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13675 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut0 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13676 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut0 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13677 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut0 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13678 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut0 (opt2)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13679 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut0 (opt3)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13680 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut0 (opt4)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13681 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut0 (opt5)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13682 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut0 (opt6)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13683 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut0 (opt11)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13684 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut0 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13685 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut0 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13686 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut0 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13687 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut0 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13688 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut0 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13689 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut0 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13690 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut0 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13691 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut0 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13692 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut0 (opt1)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13693 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut0 (opt1)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13694 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut0 (opt2)
  source 1..1834: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13695 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut0 (opt3)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13696 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut0 (opt4)
  source 1..1834: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13697 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut0 (opt5)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13698 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut0 (opt6)
  source 1..1834: mol_type = other RNA
gggagagcggctcggccattttgtcccagtcagtccggaggctgcggctgcagaagtaccgcctgcggagtaactgcaaagaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13699 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut0 (opt11)
  source 1..1834: mol_type = other RNA
gggagagcggctcggccattttgtcccagtcagtccggaggctgcggctgcagaagtaccgcctgcggagtaactgcaaagaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13700 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut0 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13701 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut0 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13702 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut0 (opt2)
  source 1..1843: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13703 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut0 (opt3)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13704 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut0 (opt4)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13705 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut0 (opt5)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13706 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut0 (opt6)
  source 1..1843: mol_type = other RNA
gggagacccgtgacccggaagttgtacggctacgcgactttccctcccacaaaccctcgcgcccttcctttcctacttgggcccggcagaaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13707 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut0 (opt11)
  source 1..1843: mol_type = other RNA
gggagacccgtgacccggaagttgtacggctacgcgactttccctcccacaaaccctcgcgcccttcctttcctacttgggcccggcagaaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13708 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut0 (opt1)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13709 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut0 (opt1)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13710 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut0 (opt2)
  source 1..1898: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13711 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut0 (opt3)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13712 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut0 (opt4)
  source 1..1898: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13713 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut0 (opt5)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13714 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut0 (opt6)
  source 1..1898: mol_type = other RNA
gggagagcggctcggccattttgtcccagtcagtccggaggctgcggctgcagaagtaccgcctgcggagtaactgcaaagaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13715 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut0 (opt11)
  source 1..1898: mol_type = other RNA
gggagagcggctcggccattttgtcccagtcagtccggaggctgcggctgcagaagtaccgcctgcggagtaactgcaaagaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13716 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut0 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13717 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut0 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13718 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut0 (opt2)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13719 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut0 (opt3)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13720 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut0 (opt4)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13721 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut0 (opt5)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13722 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut0 (opt6)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13723 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut0 (opt11)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13724 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut0 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13725 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut0 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13726 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut0 (opt2)
  source 1..1897: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13727 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut0 (opt3)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13728 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut0 (opt4)
  source 1..1897: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13729 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut0 (opt5)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13730 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut0 (opt6)
  source 1..1897: mol_type = other RNA
gggagagtcccgcagtcggcgtccagcggctctgcttgttcgtgtgtgtgtcgttgcaggccttattcaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13731 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut0 (opt11)
  source 1..1897: mol_type = other RNA
gggagagtcccgcagtcggcgtccagcggctctgcttgttcgtgtgtgtgtcgttgcaggccttattcaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13732 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut0 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13733 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut0 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13734 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut0 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13735 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut0 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13736 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut0 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13737 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut0 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13738 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut0 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13739 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut0 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13740 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut0 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13741 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut0 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatcgcgtccgggatcgccgtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcgtacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgccgggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactacgtgaacaagcaggagggcaagtccctgtacgtgaagggggagcccatcatcaacttctacgaccccctggtcttcccgagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13742 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut0 (opt2)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13743 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut0 (opt3)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatagccagtgggatcgctgtgtgtaaggtcttgcacctcgagggagaagtgaacaaaattaagaatgccctgctgtccacaaacaaagcggttgtgtctctcagcaatggcgtctccgtgttaacgttcaaggtactggaccttaagaactacatcgataaacaattgctgccaattctaaataagcagtcatgcagtatcagcaacatagagactgttattgaatttcagcagaaaaataacaggctcctggagatcacccgggagttctctgtgaatgccggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgtataatcaaggaggaagttttagcatatgtggtacaactgcctctctacggggtgattgacacgccatgctggaaacttcatactagccccctgtgtacaaccaacactaaggagggatcgaatatctgcttgacacgaaccgatcgtggctggtactgtgacaacgctggctctgtctcctttttccctcaggccgaaacgtgcaaggtgcagtcaaatagagtgttttgtgataccatgaacagtagaacactgccaagcgaggtgaatctctgcaacatagacattttcaatcccaaatatgattgcaagatcatgacttccaaaaccgacgtctctagctcagtgatcacaagtctgggggcaattgtatcctgttacggaaagactaaatgcaccgctagcaacaagaataggggtatcattaagacattttctaacggctgtgattatgtttcaaataaaggggtggacaccgtcagtgtgggaaacactctttactatgtcaacaagcaagagggcaaaagcctgtacgtgaagggtgaacctataatcaatttctatgacccattggtttttccgtccgatgagttcgacgcctctatttcgcaggttaacgagaaaatcaatcagagcctcgcgtttatccggaagtccgatgaactgttacacaacgtaaatgtcgggaagtcaacgacaaacattatgataaccactatcattatcgtgattatcgttatactgctactcctgatcgccgtgggacttttcttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13744 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut0 (opt4)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13745 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut0 (opt5)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccattgcgagcggaatcgccgtctgtaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgcagcatctctaacattgagacagtcatcgaatttcagcagaaaaataaccggctcctggagatcacccgcgagttctccgtgaatgctggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgtattatcaaggaggaagtgctggcctatgtcgtgcaactccccctgtacggcgttatcgacaccccttgctggaaactgcatacatctcccctctgtacgaccaacacaaaggagggctccaatatttgcctgacccggacagatcgcgggtggtactgtgacaacgcgggaagcgtgagctttttccctcaggccgaaacctgcaaggtccagtctaatagagtgttttgtgatacgatgaactccagaacactgccgtctgaggttaatctctgcaacatcgacattttcaatcccaaatatgattgcaagatcatgaccagcaaaaccgacgtgtccagctctgtcattacatccctgggcgctatcgtgagctgttacgggaagaccaaatgcacagcctctaacaagaatcggggaatcattaagacgttttccaacggctgtgattatgtcagcaataaaggggtggacaccgtttccgtgggaaacacactttactatgtcaacaagcaagagggcaaatctctgtacgtgaagggcgaacctatcattaatttctatgaccccctcgtttttcctagcgatgagttcgacgcttccatctctcaggtgaacgaaaagattaatcagagcctggcctttatccgcaagtccgatgagctgctccacaacgtcaatgtggggaaaagcaccacaaacattatgatcaccacgatcattatcgtgattatcgttattctgcttctgctcatcgccgtcggactgttcctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13746 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut0 (opt6)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactcccaatacttaaaacaaacgcaatcacaacaatactagctgcagtcacactatgcttcgcctcatcacaaaatataacagaagaattttatcaatcaacatgctccgcagtatcaaaaggatatctctctgcattacgaacaggttggtacacctcggtaataacaatagaattatcaaacataaaagaaaataaatgcaatggaaccgatgccaaagtaaaactaatcaaacaagaacttgacaaatacaaaaacgcagtaacagaactacaactattaatgcaatcaacaccagcagcaggttcaggctccgcaatcgcttcaggaatagccgtttgtaaagtactacacttagaaggagaagtaaataaaataaaaaacgccttactatcaacaaacaaagcagtagtctccctttccaacggagtatcagtcttaacttttaaagtactcgacttaaaaaattacatcgacaaacaactactacccattctaaataaacaatcatgctcaatatcaaacatcgaaacagtaatcgaatttcaacaaaaaaataatagattactagaaataacacgagaattttccgtaaatgccggagtaacgaccccagtctcaacatacatgttaacaaactcagaattactatcactcattaacgatatgccaataacaaatgaccaaaaaaaactaatgtcaaacaacgtccaaatagtacgacaacaatcatactctatcatgtgtataataaaagaagaagttttagcatacgtagtacaactaccactttacggagtcatagacaccccatgctggaaactacacacatcacccttatgtacaacaaacaccaaagaagggtctaacatatgtctcactagaacagatcgaggctggtactgcgacaacgcaggatcagttagctttttccctcaagccgaaacctgtaaagtacaatccaatcgagtattttgcgacactatgaactctagaaccttaccctccgaagtaaacctatgtaacatagacatatttaatcccaaatatgattgcaaaatcatgacatccaaaacagatgtatcaagctctgtaataacctcactaggagcaatagtttcatgctatggtaaaacaaaatgcaccgcctcaaacaaaaatagagggataatcaaaaccttctcaaatggatgcgactacgtatcaaataaaggagtagacaccgtctccgtaggaaacacactatactacgtaaacaaacaagaaggaaaatcactatacgtaaaaggagaaccaatcataaacttctacgacccacttgttttcccatcagatgaatttgatgcctccatatcacaagtaaacgaaaaaataaaccaatctctagccttcatcagaaaatccgacgaacttttacacaacgtaaacgtaggtaaatcaacaaccaacatcatgataacaacaataataatagtaataattgtaatacttttactacttatcgccgtaggcctattcttatattgtaaagcaagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13747 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut0 (opt11)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactaccaatcctcaaaaccaacgccatcactacaatcctagccgcggtaaccctgtgcttcgcctcctcacaaaacatcacagaagaattttaccaatcaacctgctccgccgtatccaaaggatacctgagcgccctgagaaccggctggtacacctccgtcatcaccatagaactctccaacatcaaagaaaacaaatgcaacggtacggacgccaaagttaaactcatcaaacaagaacttgacaaatacaagaacgccgtcacagaactgcaactcctcatgcaatccacccccgccgccggctccggctccgccatagcctccggcatcgccgtctgcaaagtcttacacctagaaggcgaagtcaacaaaatcaaaaacgcactactttccacaaacaaagccgtcgtctcactctccaacggcgtatccgtcctcaccttcaaagtacttgacctcaaaaactacatcgacaaacaactactccccatcctgaacaaacaatcctgctcaatctccaacatcgaaaccgtaatcgagttccaacagaaaaataatcgcctcctggagatcacccgcgagttctccgtcaatgcaggagtcacaaccccagtatcaacctacatgctcaccaactccgaactcctgtcgctcatcaacgacatgcccatcacaaacgaccaaaagaaactcatgtccaacaacgtacaaatcgtcagacaacaatcctattctataatgtgcatcatcaaagaagaagtcctcgcctacgtcgtacaactccccctctacggcgttatcgacaccccctgctggaaactccacacctcacccctctgcaccaccaacacaaaagaaggctccaacatctgcctcactcggaccgaccgcggctggtactgcgacaatgccggcagcgtctccttcttcccacaagccgaaacctgcaaagtccagtccaaccgcgtattctgcgacactatgaactccagaaccctcccctccgaagtaaacctctgcaacatcgacatcttcaacccaaaatacgactgcaaaatcatgacctcaaaaaccgacgtcagctcgtcagtcataaccagcctcggagccatagtctcatgctacggaaaaaccaaatgcaccgccagcaacaaaaaccgcggcataataaaaacattctccaacggctgcgactatgtatccaacaaaggagtcgataccgtctccgtaggcaacaccctatactacgtcaacaaacaagaaggcaaatccctctacgtcaaaggtgaaccaatcatcaacttctacgaccctctcgtcttcccctccgatgagttcgacgcctcaatcagccaagtaaacgaaaagataaaccaatcactcgccttcatccgcaaatccgacgaacttcttcacaacgtcaacgtcggcaaatctaccaccaacataatgataaccaccatcatcatcgtcatcatcgtaatactcctccttctcatcgccgtcggcctattcctatactgcaaagcccgctagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13748 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut0 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt
